United States Patent 11,446,398 (REGULATED BIOCIRCUIT SYSTEMS) - sequence listing, part 39

SEQ ID NO: 126256 - DNA, 504 bp, Homo sapiens
  Payload ID: 4758
  Gene Symbol: DENND3
  Gene Name: DENN/MADD domain containing 3
  ENST ID: ENST00000517985
  CDS Start-End: 1-369
gtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtggtgagtacacgaagcgtcaggaaagaagcctctgaattcacgtgatttctgaaacccaagtgtgttcatccatattcgacagtaggatacaagctattccacagcctcactcggtttctgtaaacagggggtcttaactttcacctggagttttcaaattaaatgtaagcttgttccaaa

SEQ ID NO: 126257 - DNA, 664 bp, Homo sapiens
  Payload ID: 4758
  Gene Symbol: DENND3
  Gene Name: DENN/MADD domain containing 3
  ENST ID: ENST00000520725
  CDS Start-End: 1-512
gcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtagggtggagggcccgccatccccagcatccccggcaggtctcgcttgccctggccgcatccccatgctcccgagagccagccgcacgccctcgtgccctcctgccttcgcctctcagggttcccctcctaacaggcacgtgcagggttggtgccaacgggcccacaggtcaccatgtgctggtttcatggtgtggtccaagcactccacagcgcattcccccaaactggatggcttcaaatgacagaacttaattttctcacagttctcgacgctggaggtccaaaaccaaggtgtcggcagagccgcttccctcgggggctcggggggagcgtgcactccaggcccttctctcccccacccgctcatgtggccgccgtccttggcgtgccctggctgtggacgt

SEQ ID NO: 126258 - DNA, 899 bp, Homo sapiens
  Payload ID: 4758
  Gene Symbol: DENND3
  Gene Name: DENN/MADD domain containing 3
  ENST ID: ENST00000520986
  CDS Start-End: 60-899
cgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaag

SEQ ID NO: 126259 - DNA, 560 bp, Homo sapiens
  Payload ID: 4758
  Gene Symbol: DENND3
  Gene Name: DENN/MADD domain containing 3
  ENST ID: ENST00000519291
  CDS Start-End: 187-560
cttttcctggtggcgccgtgaagatctgtgtgtgtagttcttggaaagattccaggtgcttgaaaacgacgtctcagtgggtcaagggttgcttataaaaagggagtcaaacatctttctgctcttcttgatccagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgt

SEQ ID NO: 126260 - DNA, 850 bp, Homo sapiens
  Payload ID: 4758
  Gene Symbol: DENND3
  Gene Name: DENN/MADD domain containing 3
  ENST ID: ENST00000518347
  CDS Start-End: 97-723
cggcccccaggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctggtgagctggggcaccgggggccaggggtggtagggggcagctctttgtgcctctccaggtgagccaagggaccagggggctggaggtggtgggggggcagctctctgttcctctcctggtgagccggggga

SEQ ID NO: 126261 - DNA, 906 bp, Homo sapiens
  Payload ID: 4758
  Gene Symbol: DENND3
  Gene Name: DENN/MADD domain containing 3
  ENST ID: ENST00000523058
  CDS Start-End: 34-906
gagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtccagccgtgtctcagtagccattctgtgaatacagaatttgaactgaagtgtgacttcaaagtatttaacatgaagtcgctccagattgtgttacctgcccgagcagaccccgaaagccccatcctggacctggac

SEQ ID NO: 126262 - DNA, 2959 bp, Homo sapiens
  Payload ID: 4758
  Gene Symbol: DENND3
  Gene Name: DENN/MADD domain containing 3
  ENST ID: ENST00000523308
  CDS Start-End: 644-1390
cagttctgcttgttcacatacagtcggtctcatcatttggagattccgtatttgcaaattcgaccacctgctaatatttacttgtaactcccaaaacagatactcgtggtattttcttggtgatccacagacatccacgtgcacagacgggggaaaaacttgagtcacctgatatggattttctgggccaacaagtgtcctctcctcggcctgattggtgccacagttttcacattttttgcttttcgttggtgattttgccatttaagaaagcctcaagcatggagctccctaagcacaaggaggcggtgacgtgtcttgcagagaaaatgcatgtgtgagatgagcttggttcaggccgcagtgacagtgctggcggccgtgggtttcgtgttaatgaatcaatcatacgtagtcaataaggtgtctgtgaacagagcacgcggagaacaaggttatgcactgatgggtggatgacaacgtcagggccagaggctcccaggaccctgagccggcgtgtcccctaggagcagtggttccatatccgctaattcagcacgtgcagtaaatgtatagaatatgacttcaccagtatcgagactgactgatttctcacgttcccgtggcctcctgttagaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaa

SEQ ID NO: 126263 - DNA, 8665 bp, Homo sapiens
  Payload ID: 4759
  Gene Symbol: DENND4A
  Gene Name: DENN/MADD domain containing 4A
  Uniprot ID: Q7Z401
  ENST ID: ENST00000443035
  CDS Start-End: 217-5937
aagcgggctcagagcgccgcggcattcagcccctcgtgttccgctaccgcgcgtgcgggattccggcgccgctctccgagctcgatccgctgctcgcacgggagccagctgggtgttatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcaaattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcagatggcagtgacctggatgctgttagtcatggcagcatggatagtggtcatgggacacacactgtggagcaggcaccttttaatacgggtttaatcaaagtatatgctactgatgatagatctagtacaggtggccagtctgatcttggatataattcattatctaaagatgaagttagaagaggggatacatctactgaagacattcaagaagaaaaagataaaaaagggagtgattgtagttccttgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctggaagatactttctaaagtcaagcccatcaacagaaaatatgcactttccatcctccatttcaagtcagacgaggcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagctatgtctaaatgtccaatatttccaatggccaggagtattagtacttctggccccttggataaggaagatactggaagacagaagctcatttctacaggcagcctgccagctactttacaaggagctacagattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaacaaaattagttgccataaaatatgacaactgctttatggtttcttttggaagagacagattgaaaaatcatgaatggaatctaaacagaaatgtcagatgaacgtatttcctgttttcatagactattcaaatgttttgaccatgaagttgtattatacatattttaaattgtttatagtaagttgatatttttttaatttttaaatttaatatagcaaacttaaaatgaatttaaacttaagcaagcaagcgtgtattttccttgtctgctgctatttgaagtaattagtacagctgcagatctctctgtgtatatctatctatatatatattttttattacttgggagaatgaattttaaaatgtcagtgctagtgtcaagtgttgtcctaggattgcatgttagtacccctaagcctgagtgtggggagtgagttatgcaagggtagcgtgcactgcccagactgactcatggagccttgtgcaaggagagccagagaggttcactataccatgactccaaaattgtctctattgctaatagatacgtatagtatacagggaaaacagcttataaatccaaatatcaatttaaattttaatattctacatgaaaacttacattgggaaatatgcagacaagtgattatattccaaattttacccttattttaatatctaaaatattgggtatgatgcaaattatactatagaatatttatctgaaatatgacttactggggtattctgttaatactatatataaatattcagaatttttttcaaaagtagaaaaattcccctctaaaagtacagccagatagattttcatccatattgaggaacttagctttttcaacaagcttcagaatctgaagtctgtagaatctaaaatacagaaatatccagaaatcagacaataaattgaaagtttagacatcatgagtattaaatagctttaaaaatatatttttagtcatattatttctaatgtaactttctttgggtaatttctggtaaggaaaaacatcttttggctgctagaattagttatagattttcaatatgtgtgtgtgtttgcacacattatcattagtgaaggaattccctagccagctttaaagaaggaaaaaatggatagtcccaaattaggtgtataaagccagtagagtccacgacacttggactggaggtatcttggagtcctgagacttagaatcagttcagctgcagaaaacccaccttttgagttcacaccattagtgaatagcaccatgctgaaacatttcacagcttccaactctgggaaataatggagagagtttaaaaatgtaaaacttcagttagtttggggctgaacttgcttacttgaaaaatctggtgctaggcacatatatctgcctctcctttgtaaataccactccaatattattctttactattcagatccaagcttcatgttctacttgttcttcatgttctttaaatcatttgaaagttgtcaactgagagaaacatttcagaggggggaggcttttggcactggtgataaacatccctccaagagaaccgtctggggttctcttctatttgtggttggtggtttttattcttttaaaaacagctttcattgttgtttactttttgtgtaatacaaacaaaatgtaggaatcatagtttattgatttcaaatggctgacaaagaatgagtaaaaccattctttatggttttacgattcagactcatttggaaaagcgaatgtaatttttacctcctctttccaccccaagttttgtttctgcttttggagagggttgtatttcccctacttttaatccctagggaatattattgcacagatttagtcttaaaacctaaaacacaaatacaaagtggtaaacctgttcaaaagaaaattaaaatgtgaatcattcttgagctgggcgtggttgctcatggaggcctgtaatcccagcactttgggaggctgaagcagggaggattgcttgagtccaggagttcaaaaccagcctgagcaacatagagagaccctgtctctacaaaaaaattttttaaatttgctcggtatggtggctcatgcttggtaatcccagctactcgggaggctgaagcaggaggatcactttgagcctgggggtttggggctgcaatgagctgtgatcatgccattgcactctagcctggattacagagcaagaccctgtctcaaaaaaaaaaaaaaaaaaaaaaaaaaaaaccagaaaatatcaatcatttaaaataactctatacaaacttttcttcaattttctgttaaccatacattttggagaataatggccaatcatgttggagagaaatgcccttttgctacagcatctgtcttttattttcttactcttagttttgtttatatgtttaaatggttgacaataaaccatgtcctgtgctgatgta

SEQ ID NO: 126264 - DNA, 5875 bp, Homo sapiens
  Payload ID: 4759
  Gene Symbol: DENND4A
  Gene Name: DENN/MADD domain containing 4A
  Uniprot ID: Q7Z401
  ENST ID: ENST00000431932
  CDS Start-End: 210-5801
aagcgggctcagagcgccgcggcattcagcccctcgtgttccgctaccgcgcgtgcgggattccggcgccgctctccgagctcgatccgctgctcgcacgggagccagctgggtgttatttctcaaactctgaggctgcggagttcacacattgaaatctgtcatctttttcagagagaaactttcgatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcaaattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttccttgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctggaagatactttctaaagtcaagcccatcaacagaaaatatgcactttccatcctccatttcaagtcagacgaggcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagctatgtctaaatgtccaatatttccaatggccaggagtattagtacttctggccccttggataaggaagatactggaagacagaagctcatttctacaggcagcctgccagctactttacaaggagctacagattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaa

SEQ ID NO: 126265 - DNA, 480 bp, Homo sapiens
  Payload ID: 4759
  Gene Symbol: DENND4A
  Gene Name: DENN/MADD domain containing 4A
  ENST ID: ENST00000561863
  CDS Start-End: 1-79
gagtacacacaactgtgatagaccaccaagtacaggggtgatggaatgtcgaaaaacctttggagaaccttatctttaagatgtatttaacttgaaagctgctatttggcactttatctcagagcaagaagagaaagagcaggctgtctctttgagaagacccttgtccttcgtgctaaagttagcatgtgctgcctcttcctgtctggatataagactaagctttatttcaaaactgaaccctctagcagctgcataccagtttaccttaatatccttagtacttggtgtcttaacatcctcatactaccttgctcctttggcctcaaagtaagcatattggctggcttatatttcttaacaaaattagcagtacacaaattgaagaattttcatctttgattacaaaagtctgcgcatgtgcttgtactctgagatggtaatagattcttctgataaagttattgctgcctttccaca

SEQ ID NO: 126266 - DNA, 3389 bp, Homo sapiens
  Payload ID: 4759
  Gene Symbol: DENND4A
  Gene Name: DENN/MADD domain containing 4A
  ENST ID: ENST00000564674
  CDS Start-End: 386-3389
attgccaagatggcgccggtcgcggtggccgcggaggctagagtcggagaaagaggcggaggcagtggcggccgcgaggggagggggagtcccgtctgactgagacggcaggcctgggcgggcgggcgggggtgccgcgaagggcggagcgccgggctggggatgagctaagcgggctcagagcgccgcggcattcagcccctcgtgttccgctaccgcgcgtgcgggattccggcgccgctctccgagctcgatccgctgctcgcacgggagccagctgggtgttatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcaaattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttccttgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacac

SEQ ID NO: 126267 - DNA, 5887 bp, Homo sapiens
  Payload ID: 4759
  Gene Symbol: DENND4A
  Gene Name: DENN/MADD domain containing 4A
  ENST ID: ENST00000635620
  CDS Start-End: 101-5851
tatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcaaattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcagcagatggcagtgacctggatgctgttagtcatggcagcatggatagtggtcatgggacacacactgtggagcaggcaccttttaatacgggtttaatcaaagtatatgctactgatgatagatctagtacaggtggccagtctgatcttggatataattcattatctaaagatgaagttagaagaggggatacatctactgaagacattcaagaagaaaaagataaaaaagggagtgattgtagttccttgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctggaagatactttctaaagtcaagcccatcaacagaaaatatgcactttccatcctccatttcaagtcagacgaggcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagctatgtctaaatgtccaatatttccaatggccaggagtattagtacttctggccccttggataaggaagatactggaagacagaagctcatttctacaggcagcctgccagctactttacaaggagctacagattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacagtcaaagtcgtactcttttgtttgagacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattg

SEQ ID NO: 126268 - DNA, 5706 bp, Homo sapiens
  Payload ID: 4760
  Gene Symbol: DENND4B
  Gene Name: DENN/MADD domain containing 4B
  Uniprot ID: O75064
  ENST ID: ENST00000361217
  CDS Start-End: 420-4910
cgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccagtgtccccagccccaaatctgctggtgccagtggcagcaaagatgctcctgtccctggtggtcctggccctgtgctcagtgaccgaaggctctgccttgctctggatgagccccagctctgcaacgggcacatggggggagcctcccggcgggttgagagtggggcatgggcatacctgagccccctggtgctgcgtaaggagctggagtcgctggtagagaacgagggcagtgaggtgctggcgttgcctgaactgccctctgcccaccccatcatcttctggaaccttttgtggtatttccaacggctacgcctgcccagtattctaccaggcctggtgctggcctcctgtgatgggccttcgcactcccaggccccatctccttggctaacccctgatccagcctctgttcaggtacggctgctgtgggatgtactgacccctgaccccaatagctgcccacctctctatgtgctctggagggtccacagccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggggaatctaccgtgagatattattcctgacaatggctgctctgggcaaggaccacgtggacatagtggccttcgataagaagtacaagtctgcctttaacaagctggccagcagcatgggcaaggaggagctgaggcaccggcgggcgcagatgcccactcccaaggccattgactgccgaaaatgttttggagcacctccagaatgctagagaccttaagcttccctctccagcctagggtggggaagtgaggaagaagggattctagagttaaactgcttccctgttgccttcatggagttgggaacaggctgggaaggatgcccagtcaaaggctccaagcgaggacaacaggaagagggatccactgttaccaaaagtcctgattcccccatcaccaacctacccagtttgttcgtgctgatgttgggggagatctggggggagttggtacagctctgttcttcccttgtcctataccgggaactcccctccagggtacccacagatctgcattgccctggtcattttagaagtttttgttttaaaaaacaactggaaagatgcagagctactgagcctttgccctgaatgggaggtagggatgtcattctccaccaataatggtccctcttccctgacgttgctgaaggagcccaaggctctccatgcctttctacctaagtgtttgtattttattttaaattatttattctggagccacagcccccttgcttatgaggttcttatggagagtgagaaagggaagggaaatagggcaccatggtccggtggtttgtagttccttcaaagtcaggcactgggagctagaggagtctcaagctccccttaggaagaactggtgccccctccagtcctaatttttcttgcctgccccgccttggggaatgcctcacccacccaggtcctgacctgtgcaataaggattgttccctgcgaagttttgttggatgtaaatatagtaaaagctgcttctgtctttttc

SEQ ID NO: 126269 - DNA, 3781 bp, Homo sapiens
  Payload ID: 4760
  Gene Symbol: DENND4B
  Gene Name: DENN/MADD domain containing 4B
  ENST ID: ENST00000368646
  CDS Start-End: 126-3781
tcccctctgaagcaccccccacgcttctgggcccctgctgcgagctacccaccaggctttttcccagcttctgcaccctggggcgcctcaggacccttggggctcctactccccggggttgggccatggaggcagatgcagtgagtgaggggggggccatggcggaggagcggcccccccggctggtggattacttcgtggtagctgggcttgcagggaacggagcacccatccctgaggaaacgtgggttcctgaacccagtgggcccctgcgccctccccggccagctgagcccatcacagatgtggcagtcatcgctagggcactgggcgaggaagtgccccagggctacacatgcatccaggcttctgctgggggccaccccttggaactcagtgctggacttctgggtggaactcaacccgtcatctgctaccgcaggggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcagagctgctgggccgctacccggaggaggacaatgaggcgttcccgctgcccgagtcagtgcccgtcttctgcctgcccatgggggccactatcgagtgctggcctgcccagaccaagtaccccgtgcccgtcttctccacctttgtgctcacgggtgcagctggtgataaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgccttcctcaccttcctttaccgctactccgtctcaggcccccaccgcctacccttggaagcgcacatctcccacttcattcacaacgttcccttcccttccccacagagaccccgcatcctagtgcagatgtctccctatgacaacttgctcctctgtcagcctgtatcctcacccctgcccctcagtggtgccagcttcctgcagctgctgcagagcctgggccctgagctggctatcacactgctgctggctgtgctcacagagcacaagctgctagtccactcgctgcggccagacctgctcaccagcgtctgtgaggccctcgtctcgatgatcttcccactgcactggcagtgcccctacattcctctgtgcccgctggtgctggcagatgtgctgagtgccccagtgcccttcattgtgggtatccactccagctactttgatctgcatgacccgcctgctgatgtcatctgtgtagaccttgataccaacacgctcttccagactgaggaaaagaagctcctctcccctcggaccctgccccgcagaccctacaaggttctgctggccacactgacaaacctgtaccagcagctggaccagacatacactggacctgaggaggaagcatccctggagttcctactgacagactacgaggcagtgtgtggccgcagggcccggctggagcgcgaagtccaaggagccttcctccgcttcatggcctgtctgctcaagggctaccgggtcttcctgcgcccactcacccaggccccctccgagggagctcgtgatgttgacaaccttttcttcctgcagggcttcctcaaatcccgggaacgctccagccacaaactttactctcagctgctgcacacacagatgttctcacagttcattgaggagtgctcttttggctctgctcgccatgctgcccttgaattctttgactcttgtgttgaaaaggtccacccagagcaggagaagcctgagccgacacccttagtggagctagaggagctgtcaggaagtgagctcactgtctttatcacacctcccgaggagcctgccttaccagagggcagtgaatccactccccagtactgctatgatggattcccagagctacgggctgagttgtttgagtctcttcaagagcaacctggggccctgcctgtgccaggcccttcccgtagcgcccccagcagtcctgctcctcgccgtaccaaacaggagatgaaagttgcacagcggatggcacagaagtcagcagctgtgcctgagctgtgggcccggtgcctgctggggcactgctatgggctgtggttcctgtgtctgcctgcctatgtgcggtcggcaccctcccgagtgcaggcactgcacacagcctaccatgtgctgcgccagatggagagcggcaaggtggtgctccctgatgaggtgtgttaccgggtactgatgcagctctgctcacactatgggcagcctgtgctgtctgtgcgggtcatgctggagatgcgtcaggcaggcattgtgcccaacaccatcacctatggctactacaataaggctgtgttggaaagcaagtggccgtctggcacaccaggtgggcgtctgcgctgggccaagctccggaatgttgtcctgggggctgctcagttccgccagcccttgagagaacggcaacagcagcagcagcagcaacagcagcagcagcagcagcagcagcaggagcaggtgtcagcacatcaagaggcaggcagctcccaggcagagccctatttggagcgcccttcccctactcgccctcttcagcgccagactacttgggctgggcgaagtctgagagacccagcctcaccccctggacgcctggtgaagagtggtagcctgggcagtgcccgaggggcacagcccactgtggaggccggtgtggcccacatgatagaggccttgggggtcctggaaccccggggatcacctgtgccctggcacgatggaagtctctcagacctgagcctgacaggggaggagccgctccctggaggcagcccagggggctcaggctcagccctgagtgcccagtccactgaggccctggaagggctaagtgggcggggacccaaggctggtgggcgacaggatgaggcaggcaccccccgacgagggctgggtgcccgcctccaacagctgctcactccttcccgccactcccctgcctcccgcattcccccacctgagctgcctcctgacctgccacccccagcccgccgcagccccatggacagtcttctgcacccccgggagcgccctggatccactgcctccgagagctcagcctctctgggcagtgagtgggacctctcagaatcttctctcagcaacctgagtcttcgccgttcctcagagcgcctcagtgacacccctggatccttccagtcaccttccctggaaattctgctgtccagctgctccctgtgccgtgcctgtgattcgctggtgtatgatgaggaaatcatggctggctgggcacctgatgactctaacctcaacacaacctgccccttctgcgcctgcccctttgtgcccctgctcagtgtccagacccttgattcccggcccag

SEQ ID NO: 126270 - DNA, 541 bp, Homo sapiens
  Payload ID: 4760
  Gene Symbol: DENND4B
  Gene Name: DENN/MADD domain containing 4B
  ENST ID: ENST00000472932
  CDS Start-End: 1-541
gggccgtgacaagccccccctcgttgagctgggggtgttgtatgaggggaaggaacgtcccaagcctggcttccaagtgcttgacacgacaccctacagccactcagcaaacctggcccctccaggccccgggcacccccgcacctacctcacttaccggcgggcagcagagggggcagggctgcatgccctgggcatcactgacctctgcctggtgctgcccagtaagggcgagggcactcctcatacttactgccggctgccccgcaacctcaaccctggcatgtggggcccagcagtgtacctgtgctataaggtgggcctggcgaaggccaacacgctggtgtacgaggcaggtgtatggtgccgccctgcagttctacgaggcgttcccaagggccaggctatcagagcgacaggcacgggcactgggcctgctgagcgccgtggagcggggtcgggcactggggggcagagctgtgcgcagccggcgtgccatcgctgtgctgtcccgctggcctgccttccctgccttccgcgc

SEQ ID NO: 126271 - DNA, 3463 bp, Homo sapiens
  Payload ID: 4761
  Gene Symbol: DENND4C
  Gene Name: DENN/MADD domain containing 4C
  ENST ID: ENST00000361024
  CDS Start-End: 1-2091
ggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaa

SEQ ID NO: 126272 - DNA, 1547 bp, Homo sapiens
  Payload ID: 4761
  Gene Symbol: DENND4C
  Gene Name: DENN/MADD domain containing 4C
  ENST ID: ENST00000380424
  CDS Start-End: 1-1061
atgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaaggtatcaaagggtacagagacctctttatgtagtaataaatggggtacccttgtaaaaattctgtctctaaagacaacctgactcatataggcataagttctggcatttaagagtacatcttaacttattaccacatagtgtttaacgagctaatgaatgaatctgatgataaaccatttttgaactaagtttaatattttacagttgtcttttacaaaatgaacttctcaacagtaaaatatttcccttttaatatagtcattgccagtttccagaggcgaaatgttctctttctgtgaaatgtacacttggcccttaaatactaattgaatcaaacatttattgagactctattgtatgctaaatattatgctaagctctaaaaataaaaaagtaaatatgactgggtctctctccttaggtggatcgtggcctagtagagattaaatacttgtcagtgtctttattgtacttatttgcatatagcatacttctaggtaattttgtttaataaagatgaaataatatttgagtaaagcaa

SEQ ID NO: 126273 - DNA, 3479 bp, Homo sapiens
  Payload ID: 4761
  Gene Symbol: DENND4C
  Gene Name: DENN/MADD domain containing 4C
  ENST ID: ENST00000380427
  CDS Start-End: 1-2645
cacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaagaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaa

SEQ ID NO: 126274 - DNA, 5335 bp, Homo sapiens
  Payload ID: 4761
  Gene Symbol: DENND4C
  Gene Name: DENN/MADD domain containing 4C
  ENST ID: ENST00000494124
  CDS Start-End: 1-1136
cagatgtacctcttttctgccttcctatgggagctactattgagtgctgggatcctgaaaccaaatatccacttccagttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccgagaatccttgtccagctgtcagtccatgatgcattaatattatcacagccagtttctacacctttaccactaagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtatcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacaggttgtttcctgataaaggcacagagaaaacagataaggttgattttgattcagcagaagataccagattgatagaactagatgattcacagaaaagtgagcatactgtatttataatgccgccagagccacctcctgatgatggaaaggacctgtcaccaaagtacagttacaaatactttccaagactggaccttaagctttttgacagaccgcaggagttgaaactttgttttagtagacaccctactgggaatagcattacaaagagtccacctctcatggctaagagaactaaacaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcagctcttcaaaatgtcacaggtggaagtgatggggacacggtgagccacggtagtgtggatagttctaatgatgctaacaatggggagcacacagtcttcgtcagagatttaatcaggcttgagtccattgataatcactctagcacagacagacttatatgacgtgaagctatggatacacgtgtgcattaattctacccttgaatgttaaccacatcaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccggg

SEQ ID NO: 126275 - DNA, 6718 bp, Homo sapiens
  Payload ID: 4761
  Gene Symbol: DENND4C
  Gene Name: DENN/MADD domain containing 4C
  ENST ID: ENST00000434457
  CDS Start-End: 417-6293
ggaggaaagggagagggagggggaaaagaaagtgctgttttgtggaaaggggcggaaggcgggggagaaaaagggaacagaaacatggcggtcaggtcttgggacggctgcgccgcgggcagctcctaggcgacgcgccgcccgcactgtccgacggctcacagcgcggaggcacccgcgcgggccagcgctccggccatcgcccctggctgtaggcggcgcccctcggagaccctgcccgcgaggcggcgcaggcgcagaccggactgaggcggcggcggccgctggagctagtcccccgccctgccctgccgagcgcgcccagtccgcgaatccggtgctttcttgccccaggaagaagccgtgtcggggctgcgctgacagaggagcaggcagcagaaaatacagtagcagccatgatagaagacaaaggaccaagagtgacagactactttgtcgtagctggtctcactgacacatctactcttttggatcaagaaataaatcgtttagatactaagtcaactggacctaaagctccaattacagacattgccattattatcaaatcagctggagaaacagtacctgaaggttacacctgtgtagaagccactccatcagctctccaagcaaacttgaactatggaagtctgaaaagcccagaacttttcctctgttataagagagggagagataaaccaccgcttacagatattggagttctatatgaagggaaagaacggcttattccaggatgtgaagtgatcctagccacaccctatggtcgctgtgccaatgtcaacaatagttcaactacttcacaaagaatctttatcacttatcgaagggctcctccagttcgaccccagaattccttggctgtaactgatatctgtgttattgtaaccagtaaaggagaaactcctcctcataccttctgcaaagttgacaaaaacttaaattgtggaatgtggggttccagcgtgtttctgtgttataagaagtctgtacctgcttcaaatgcaatagcatataaggctggtttaatttttagatatccagaagaggactatgagtcatttccactctcagaatcagatgtacctcttttctgccttcctatgggagctactattgagtgctgggatcctgaaaccaaatatccacttccagttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccgagaatccttgtccagctgtcagtccatgatgcattaatattatcacagccagtttctacacctttaccactaagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtatcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacagggatttttaaaaagtcgagatcgtgcctatgcaaaattctatacccttttatccaaaacacagatttttattcgtttcattgaagaatgcagttttgtaagtgataaagatactggattagcattttttgatgactgcatagaaaagttgtttcctgataaaggcacagagaaaacagataaggttgattttgattcagcagaagataccagattgatagaactagatgattcacagaaaagtgagcatactgtatttataatgccgccagagccacctcctgatgatggaaaggacctgtcaccaaagtacagttacaaatactttccaagactggaccttaagctttttgacagaccgcaggagttgaaactttgttttagtagacaccctactgggaatagcattacaaagagtccacctctcatggctaagagaactaaacaggaaataaaaacagctcataaattggcgaagagatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcagctcttcaaaatgtcacaggtggaagtgatggggacacggtgagccacggtagtgtggatagttctaatgatgctaacaatggggagcacacagtcttcgtcagagatttaatcaggcttgagtccattgataatcactctagcacaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacg

SEQ ID NO: 126276 - DNA, 6831 bp, Homo sapiens
  Payload ID: 4761
  Gene Symbol: DENND4C
  Gene Name: DENN/MADD domain containing 4C
  ENST ID: ENST00000602925
  CDS Start-End: 417-6146
ggaggaaagggagagggagggggaaaagaaagtgctgttttgtggaaaggggcggaaggcgggggagaaaaagggaacagaaacatggcggtcaggtcttgggacggctgcgccgcgggcagctcctaggcgacgcgccgcccgcactgtccgacggctcacagcgcggaggcacccgcgcgggccagcgctccggccatcgcccctggctgtaggcggcgcccctcggagaccctgcccgcgaggcggcgcaggcgcagaccggactgaggcggcggcggccgctggagctagtcccccgccctgccctgccgagcgcgcccagtccgcgaatccggtgctttcttgccccaggaagaagccgtgtcggggctgcgctgacagaggagcaggcagcagaaaatacagtagcagccatgatagaagacaaaggaccaagagtgacagactactttgtcgtagctggtctcactgacacatctactcttttggatcaagaaataaatcgtttagatactaagtcaactggacctaaagctccaattacagacattgccattattatcaaatcagctggagaaacagtacctgaaggttacacctgtgtagaagccactccatcagctctccaagcaaacttgaactatggaagtctgaaaagcccagaacttttcctctgttataagagagggagagataaaccaccgcttacagatattggagttctatatgaagggaaagaacggcttattccaggatgtgaagtgatcctagccacaccctatggtcgctgtgccaatgtcaacaatagttcaactacttcacaaagaatctttatcacttatcgaagggctcctccagttcgaccccagaattccttggctgtaactgatatctgtgttattgtaaccagtaaaggagaaactcctcctcataccttctgcaaagttgacaaaaacttaaattgtggaatgtggggttccagcgtgtttctgtgttataagaagtctgtacctgcttcaaatgcaatagcatataaggctggtttaatttttagatatccagaagaggactatgagtcatttccactctcagaatcagatgtacctcttttctgccttcctatgggagctactattgagtgctgggatcctgaaaccaaatatccacttccagttttttcaacttttgtcttgacaggttcttcagccaaaaaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagcacatttcacattttatgcaaaacatcccttttccttcaccacaaagaccgagaatccttgtccagctgtcagtccatgatgcattaatattatcacagccagtttctacacctttaccactaagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtatcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacagggatttttaaaaagtcgagatcgtgcctatgcaaaattctatacccttttatccaaaacacagatttttattcgtttcattgaagaatgcagttttgtaagtgataaagatactggattagcattttttgatgactgcatagaaaagttgtttcctgataaaggcacagagaaaacagataaggttgattttgattcagcagaagataccagattgatagaactagatgattcacagaaaagtgagcatactgtatttataatgccgccagagccacctcctgatgatggaaaggacctgtcaccaaagtacagttacaaatactttccaagactggaccttaagctttttgacagaccgcaggagttgaaactttgttttagtagacaccctactgggaatagcattacaaagagtccacctctcatggctaagagaactaaacaggaaataaaaacagctcataaattggcgaagagatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggtgtgctatcgagtagtgatgcagctttgtggactttggggtcatcctgttttagcagtgagagtcttatttgaaatgaaaactgctaggataaagcctaatgctattacttatggttattataataaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcaggtggtcagtctgaccaaggatacgggtctaaggatgaacttataaaggatgatgcagaaattcatgtgcctgaagaacaggcagcaagagaattgataactaaaacaaaaatgcaaacagaagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagcactggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtgaagttccatttccaagaggcatgaaagggcaagactttgaaaaatcagatcatggttcttctcaaaataccagcatgtctagcatctatcagaattgtgcaatggaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacagcttcctctgtcatctctgtcccaggatagcaaacttgtgtatattcagctgttatgggataatatcaaccttcatcaggaaccaagagaacctctgtatgtctcatggaggaattttaattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggagtttatacagagaaatcctcttcttatcattagtgtctctaggaagagagaatattgatattgaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctc

SEQ ID NO: 126277 - DNA, 5031 bp, Homo sapiens
  Payload ID: 4762
  Gene Symbol: DENND5A
  Gene Name: DENN/MADD domain containing 5A
  Uniprot ID: Q6IQ26
  ENST ID: ENST00000328194
  CDS Start-End: 322-4185
gaggagggtcacggtgggggctgtccacgcgctctccgcccttctccaggctcgctcgggccgcggcgctctcggctagctgcagcggcggcggcgcggaggggaaggcatccaggatgcggtgcggggcggcccggtgcccccccgccccgtcacggcagccgcggcggccgaggggaccgggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 126278 - DNA, 566 bp, Homo sapiens
  Payload ID: 4762
  Gene Symbol: DENND5A
  Gene Name: DENN/MADD domain containing 5A
  ENST ID: ENST00000524446
  CDS Start-End: 1-566
tcaggacaaccggcagagaaaactcacatcaggaagcctcagtacctcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctg

SEQ ID NO: 126279 - DNA, 782 bp, Homo sapiens
  Payload ID: 4762
  Gene Symbol: DENND5A
  Gene Name: DENN/MADD domain containing 5A
  ENST ID: ENST00000525784
  CDS Start-End: 1-782
tgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtc

SEQ ID NO: 126280 - DNA, 611 bp, Homo sapiens
  Payload ID: 4762
  Gene Symbol: DENND5A
  Gene Name: DENN/MADD domain containing 5A
  ENST ID: ENST00000530780
  CDS Start-End: 33-242
cgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaagagatcattgaaatgcatagtttattctgaattttaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaa

SEQ ID NO: 126281 - DNA, 728 bp, Homo sapiens
  Payload ID: 4762
  Gene Symbol: DENND5A
  Gene Name: DENN/MADD domain containing 5A
  ENST ID: ENST00000528725
  CDS Start-End: 1-560
gaggccatgccggaccccgccgctgcagcagtcccccagtgtcatccggaggcttgttaccatctcacccaacaacaagcccacgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagttta

SEQ ID NO: 126282 - DNA, 604 bp, Homo sapiens
  Payload ID: 4762
  Gene Symbol: DENND5A
  Gene Name: DENN/MADD domain containing 5A
  ENST ID: ENST00000527896
  CDS Start-End: 1-315
cccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcaggccaaaatcatattatatgatcaacctcaagtgcatgggaagctgtgaaagtgaacattgaactgggtataatgttaccctgaacagtatgaaggtctatgagcaagaaagaaggggtgaatgaattatgaagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgccca

SEQ ID NO: 126283 - DNA, 915 bp, Homo sapiens
  Payload ID: 4762
  Gene Symbol: DENND5A
  Gene Name: DENN/MADD domain containing 5A
  ENST ID: ENST00000531747
  CDS Start-End: 1-190
gggaaaggccagagcatgggtgcgactgtccatggaaaaaaagttactttccagacacctgaagcagctcctctcagaccatgagctcaccaatgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagcca

SEQ ID NO: 126284 - DNA, 743 bp, Homo sapiens
  Payload ID: 4762
  Gene Symbol: DENND5A
  Gene Name: DENN/MADD domain containing 5A
  ENST ID: ENST00000533737
  CDS Start-End: 1-587
gggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagggttatcatgaagattaaatctcttatgtcagtgccagcacatgctgagtgttatgtgagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatcta

SEQ ID NO: 126285 - DNA, 4060 bp, Homo sapiens
  Payload ID: 4762
  Gene Symbol: DENND5A
  Gene Name: DENN/MADD domain containing 5A
  Uniprot ID: Q6IQ26
  ENST ID: ENST00000530044
  CDS Start-End: 19-3744
ggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatgagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgata

SEQ ID NO: 126286 - DNA, 2861 bp, Homo sapiens
  Payload ID: 4762
  Gene Symbol: DENND5A
  Gene Name: DENN/MADD domain containing 5A
  ENST ID: ENST00000526707
  CDS Start-End: 59-2482
cgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcgggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacaca

SEQ ID NO: 126287 - DNA, 3132 bp, Homo sapiens
  Payload ID: 4763
  Gene Symbol: DENND5B
  Gene Name: DENN/MADD domain containing 5B
  Uniprot ID: Q6ZUT9
  ENST ID: ENST00000354285
  CDS Start-End: 181-2397
gcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcggttttgtaccaatggctagaagcagatcgtcatggcaagagccaaggtgctgcaaatacgacttcaggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggaggtatgtggtctaccttcctggggtgcctcacagcaagcgccatgaactaggcttattccttccagcagatgtcattgtgtagattcttaatgttctttaaaaaaaaaactgtttagttatagtttaaaatattaatccttttgtacggacatatagcagaaaacacccttttttccatttttgtaatttcaagacatctataataaggctctaaaacaagtctttctgtgtattacatcaagtaaagatcaagttgaggataaatttttagttactatgtctcctataggagaaaaattgtctgcatgagaagcctagacatttctaagtttcaagcataattataaggagtagtgtgatgtacttgcctatgctttgttcttggcttgctggcaccagttttttttcttgaatctctaaatctactttatatttttgaaagtgttttaaaactatttttaaattaagatccttacacttttatttgtactctttgaaaataagaccataattatacaacaagtaagttttgatttttttctgtgtgaaatctgcatatatatatagtgtcttgctatgttgcccaggtcttgaactcctgggctcaagcagtgctcctgcctcagcctcccaaagtattgggattacaggtgtgagctgccatgcccagcctgattgtttcgtttcttatgatcaaaagagaaatgcaatcagaagacttgttaactgttttctagtatcaaatttgtaaaaataaagcagaaaacatcatcccaaaca

SEQ ID NO: 126288 - DNA, 9470 bp, Homo sapiens
  Payload ID: 4763
  Gene Symbol: DENND5B
  Gene Name: DENN/MADD domain containing 5B
  Uniprot ID: Q6ZUT9
  ENST ID: ENST00000389082
  CDS Start-End: 266-4090
gcgagggcctctcaggccgacactccccccgcgcccctcccccacccggccgggctccggacccgccgcgcgcgagcccgcggccgcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcgggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggagaaatatatgcaagaggcacgaagtttaggaaaaaacctgaggcaacccaaactgtcagacctctctcctgcagttattgcacagaccaactgtaaattcgtagaaggcttattaaaagaatgtagaatgaagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaagaagctttataagcgatatgcttttctacgttgcgaagaagaaagagagcagtttctttaccaccttctttctctcaatgctgtggactatttctgcttcaccagtgtgttcaccactatcatgattccgtataggtcagtgatcatcccaatcaaaaagctgagcaatgcaataatcacatcaaacccttggatctgtgtatcaggagagctgggagacacaggagtaatgcagattcccaaaaacctcctcgaaatgacctttgagtgccagaacttggggaagctgaccactgttcagattggtcacgataactcaggactgttagccaaatggctagtggattgtgtcatggtcagaaatgaaatcacaggacatacatacagattcccatgtgggcggtggctggggaaaggcattgatgatgggagcctggagagaattcttattggagagttgatgacatcagcatcagatgaagatctagtaaagcagtgtcggactccaccccagcagaagtcacccaccacggctaggagattgagcatcacttcactgacaggaaaaaacaacaaacccaatgctgggcagatacaagaaggaattggagaagctgtgaacaatattgtgaaacattttcataaacctgaaaaagagagaggaagcctcaccgtgttgctgtgtggagaaaatggcctggttgcagcccttgagcaagttttccaccatgggttcaaatctgcccgcatctttcacaagaatgtcttcatctgggacttcatagagaaagtggttgcttattttgaaacaactgaccagattctagataatgaagatgatgtccttattcagaaatcatcctgcaaaaccttctgccactacgtaaatgctattaatactgcacccaggaacattgggaaggatggcaaattccagattttagtttgccttggaacaagggatcgcctgctcccacagtggattccattgttagctgagtgtcctgccatcactcgaatgtatgaagagagcgctctcctgcgagaccgcatgactgtcaactcccttatccgaattctgcagaccattcaggacttcaccatagtcctagaaggatcactcatcaaaggagtggatgtgtaacccaactggctagaaactctcagtccaaaccttgctccttccccaactaggggaccgatttggacttgtctgacagtagtgagtcactgcaggggcagccaaacatatgccccatttggaacaatcctcactctacagacaaggcaaaatgttgtattgtagttcatttgaacctggaatttagtataaaatagagtattttcatgtgttagatgtgtgtaaatatgctatcttctttaagaaattatattactctaataagatgcttttcttagattgaatattcctgtgacttaaaataagtagcttaaaaatgttgggggttggggggaagagtggtgctagccaggaagaagccagtaaacatgtaaatatagtgcaacccagtcgggcttttttttttctccaggtatcacaaagaaacccagaatgcattgttatgtagtagccatccatcttggagtctgatcctttgtattgtggatgcacacagctttacctactgtactggtagtcttcacttctatcttttaagttacaaactgttttatatatttgaatcgctagtcacttttccagtcttttggaaaaaaatttcagtccgcacaagatgatataattggagtattttaaacactagaccccaggagcttggctgaactggaaagagaacatacaaagctctgagaaatgtgttcaattgtgggattataacttctttacacttcggaaagattagcctagactaacttcattcttggcatttttattcttgttatttgaggtactttgggaagatgtgaatttcagtgttagattcatagtgataagaactgcaaacagcaatttgattctgtacttttaatttggccatctaaactgtgcagtggtctacctcttaaggataaccatgagccctgtctttgttagggtctaatcacccacctctccagggcccatcccccctcgggaaatggaaggaatgtctaaggaggaggagggctgtgtgtggcttggaatgtttttgtgaaagcatttgttgaccatgataatgcaaataacagaaggagagagagaatgaaccctttctgggtgtttcagggcaagctttacgttcctttgtaggaaggggagtaataatgtaaaacaactgacccagagaagctaaaagccactggcagcacaggctgacaaaatggaagcaaagcaagaggtggcaacaattttgaaagaccaaaagttgtgagtaactttccagtttgatagtttataaagaagttaagtaaatgtagtattggctagttactgtaagtcctcatcttctggtaggtcctgtaactctaattaggcatttgtacatttttagcagcaaaattgcctcagcagagctcccagttttattcccagttgtggctgaaaagcaaagccatggcatcagtatccttgtgcaatcggaggttgctgggctttcaccacctgtgttgttaaccttatttcctggaggaagaaacagatgaaacaagtgcctaactccctttatcaaacacagccaaggacagcctcttttaacatgtgacttcatacttgaggaaaaggagagttgacagctgtatttaaaaacccatggagccgggtgcggtggctcacgcctatgatcccagcactttgggaggccgaggcaggcggatcacaaggtcaggagattgagaccctcctggctaacaccgtgaaaccccgtctctactaaaaatacaaaaaattagccgggcgtggtggcgggtgcctgtacaggaggctgaggcaggagaatggcgtgaacccgcgaggcggagcttgcagtaagctgagatcgcgccactgccctccagcctgggcaacagagcaagactccatctcaaaaaataaatagataaaaataaaaacccatggaaatggtttaagaaaatggttctgggtacaccagaaatttgtttgcctgaagctaaagtgtgtctacaatggtacagctcttccagggacatgggaagtttatcgtgggagatatccagaacctgttttacactgggctcctactgtgtttggtgatcagaaactatagaggggtccaacccaggatttcatgtttgtatcttcataaggccatgctcctgacaggtctaggcaacctgggggatgacttaggttaatgtgctaggattgacacacctcatccagccttcttactttgtggatgggaacacttaaggaatagagagattaaatcttacacttaccccacagctggttactgacaacacaagctctagaattcatgtttgtttgtttgttttatttcaccaggctgcatgagactgaccttccggcattcttactaatagtctttctattatactattggatctttattcatccacctatacaagtaggaaataaggatgaatattcatttagaagaattaatattcatattaacacattgctctcagattattgggaattaacatcttgtaaaaactgggagcaggccaggtacggtggctaacgcctgtaatcctgacactttgggagtctgaggcgggtggttcatctgaggtcagtcgggagttcaagaccagactggccaacatggtgaaaccccgtctctactaaaaaaaaaaaatagacaaaaattagcgggggggtggtggcagggcctgtaattccagctactcaggaggctgaagcaggagaatcgtttaaacacaggaggtggaggttgcagtgagccgagattgtgccactgcactccaacctgggtgacaagagcgagactccgtctcaaaaaaaaaaaaagaaaaaaactgcagccaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttggatgatgggtccttcagtcaccttgtgagcccatgtacttattccgttgatacagcctgtgctataaacatgtggggccctccttgtgtgagctgcttgaatggccagtacccccattcttttgaatattcccaatggcagtcaatcttggcctttaagaataaatttaaatatttggaaatagtccttaggatccaagtttgatcaatgaaaaggatgcttaagctgagtttggggtcacataagaagtgcagttataaagaaataagacatgttgggcatggcagtacacacctgtagtcccagctgcttgggaagccaaggcaggaggatcacttcaacccaggagtttgagtccagcctgggtaacatagggaaaccccatctcaaaaaaacaaaacaaaggacttagtttttatgtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgatactt

SEQ ID NO: 126289 - DNA, 1723 bp, Homo sapiens
  Payload ID: 4763
  Gene Symbol: DENND5B
  Gene Name: DENN/MADD domain containing 5B
  ENST ID: ENST00000546299
  CDS Start-End: 1-1614
agtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagtaaaaagaaccatagttttccttttgtggttattagtggctttattattgattttaacatttttaaattttttattcttctgtgcctatgcttacccatatattattgattttgttaaccttttttaaatgcagactttttgtcttccagccccattaagaacttttctttaccaagtatttttacattagataaaataattttacaagcaaataaaccagctcattgaactggtca

SEQ ID NO: 126290 - DNA, 4291 bp, Homo sapiens
  Payload ID: 4763
  Gene Symbol: DENND5B
  Gene Name: DENN/MADD domain containing 5B
  ENST ID: ENST00000536562
  CDS Start-End: 152-4081
acggaccccgcctggcgcgccggccccttcgcttgcagccgcactcggaggcggccggctgaagtgcagtggcatgatctcagatcactacaacctccacctcttgggttccagtaattctcctgcctggccttcctgagtaactgggattatgggcacccaccaccatgcccagctaatttttgtatttttagtagagatgaggtttcaccatgttgatcaggctggtctcgaactcctgacctcaagcaattcacctgcctcggcctcccgaagtgctgagattacagttgtgagccaacatgcccagccaggatttttgtaccaatggctagaagcagatcgtcatggcaagagccaaggtgctgcaaatacgacttcaggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggagaaatatatgcaagaggcacgaagtttaggaaaaaacctgaggcaacccaaactgtcagacctctctcctgcagttattgcacagaccaactgtaaattcgtagaaggcttattaaaagaatgtagaatgaagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaagaagctttataagcgatatgcttttctacgttgcgaagaagaaagagagcagtttctttaccaccttctttctctcaatgctgtggactatttctgcttcaccagtgtgttcaccactatcatgattccgtataggtcagtgatcatcccaatcaaaaagctgagcaatgcaataatcacatcaaacccttggatctgtgtatcaggagagctgggagacacaggagtaatgcagattcccaaaaacctcctcgaaatgacctttgagtgccagaacttggggaagctgaccactgttcagattggtcacgataactcaggactgttagccaaatggctagtggattgtgtcatggtcagaaatgaaatcacaggacatacatacagattcccatgtgggcggtggctggggaaaggcattgatgatgggagcctggagagaattcttattggagagttgatgacatcagcatcagatgaagatctagtaaagcagtgtcggactccaccccagcagaagtcacccaccacggctaggagattgagcatcacttcactgacaggaaaaaacaacaaacccaatgctgggcagatacaagaaggaattggagaagctgtgaacaatattgtgaaacattttcataaacctgaaaaagagagaggaagcctcaccgtgttgctgtgtggagaaaatggcctggttgcagcccttgagcaagttttccaccatgggttcaaatctgcccgcatctttcacaagaatgtcttcatctgggacttcatagagaaagtggttgcttattttgaaacaactgaccagattctagataatgaagatgatgtccttattcagaaatcatcctgcaaaaccttctgccactacgtaaatgctattaatactgcacccaggaacattgggaaggatggcaaattccagattttagtttgccttggaacaagggatcgcctgctcccacagtggattccattgttagctgagtgtcctgccatcactcgaatgtatgaagagagcgctctcctgcgagaccgcatgactgtcaactcccttatccgaattctgcagaccattcaggacttcaccatagtcctagaaggatcactcatcaaaggagtggatgtgtaacccaactggctagaaactctcagtccaaaccttgctccttccccaactaggggaccgatttggacttgtctgacagtagtgagtcactgcaggggcagccaaacatatgccccatttggaacaatcctcactctacagacaaggcaaaatgttgtattgtagttcatttgaacctggaatttagtataaaatagagtattttcatgtgtt

SEQ ID NO: 126291 - DNA, 643 bp, Homo sapiens
  Payload ID: 4763
  Gene Symbol: DENND5B
  Gene Name: DENN/MADD domain containing 5B
  ENST ID: ENST00000544698
  CDS Start-End: 168-359
cgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcggagatacggggtcaaccttcattcttctgcgtaaagatatccagttttcccagcaccattgactgaagagactgtcctttctccattgtatgttctcggcacctttgtctaaagcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaag

SEQ ID NO: 126292 - DNA, 9310 bp, Homo sapiens
  Payload ID: 4763
  Gene Symbol: DENND5B
  Gene Name: DENN/MADD domain containing 5B
  ENST ID: ENST00000628277
  CDS Start-End: 1-3930
atgggcacccaccaccatgcccagctaatttttgtatttttagtagagatgaggtttcaccatgttgatcaggctggtctcgaactcctgacctcaagcaattcacctgcctcggcctcccgaagtgctgagattacagttgtgagccaacatgcccagccaggatttttgtaccaatggctagaagcagatcgtcatggcaagagccaaggtgctgcaaatacgacttcaggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcagcccaatcaattgagcagagactgatgaaaatggatcacactgcaatccacccacatctacttgatatgaaaattggtcaaggcaaatatgagcaggggttctttccaaagttacagtccgatgtcttggcaacaggaccaaccagtaacaatcgctgggtaagtcggagtgccactgcacagcgcaggaaagaacgccttcgccagcattctgagcatgttgggctggacaacgacttgagggagaaatatatgcaagaggcacgaagtttaggaaaaaacctgaggcaacccaaactgtcagacctctctcctgcagttattgcacagaccaactgtaaattcgtagaaggcttattaaaagaatgtagaatgaagacaaagcgcatgttggtggagaagatgggacatgaagcggtggaacttggccatggagaagcaaacatcaccggcctggaggagaacaccttgatcgccagcctttgtgacctgctggagaggatatggagccatggcttgcaggtcaagcaggggaagtcggctttgtggtcacatttaattcaatttcaggacagagaagagaaacaagagcaccttgcagaatcaccagttgccctcggaccagaaagaagaaaatctgactcaggagttatgttgccaacgctcagggtctctcttattcaggacatgaggcatattcaaaacatgagtgagatcaagactgatgttggacgagctcgggcgtggataagactgtctctagaaaagaagctcttgtcccagcatcttaagcagttgctttctaaccaaccactcaccaagaagctttataagcgatatgcttttctacgttgcgaagaagaaagagagcagtttctttaccaccttctttctctcaatgctgtggactatttctgcttcaccagtgtgttcaccactatcatgattccgtataggtcagtgatcatcccaatcaaaaagctgagcaatgcaataatcacatcaaacccttggatctgtgtatcaggagagctgggagacacaggagtaatgcagattcccaaaaacctcctcgaaatgacctttgagtgccagaacttggggaagctgaccactgttcagattggtcacgataactcaggactgttagccaaatggctagtggattgtgtcatggtcagaaatgaaatcacaggacatacatacagattcccatgtgggcggtggctggggaaaggcattgatgatgggagcctggagagaattcttattggagagttgatgacatcagcatcagatgaagatctagtaaagcagtgtcggactccaccccagcagaagtcacccaccacggctaggagattgagcatcacttcactgacaggaaaaaacaacaaacccaatgctgggcagatacaagaaggaattggagaagctgtgaacaatattgtgaaacattttcataaacctgaaaaagagagaggaagcctcaccgtgttgctgtgtggagaaaatggcctggttgcagcccttgagcaagttttccaccatgggttcaaatctgcccgcatctttcacaagaatgtcttcatctgggacttcatagagaaagtggttgcttattttgaaacaactgaccagattctagataatgaagatgatgtccttattcagaaatcatcctgcaaaaccttctgccactacgtaaatgctattaatactgcacccaggaacattgggaaggatggcaaattccagattttagtttgccttggaacaagggatcgcctgctcccacagtggattccattgttagctgagtgtcctgccatcactcgaatgtatgaagagagcgctctcctgcgagaccgcatgactgtcaactcccttatccgaattctgcagaccattcaggacttcaccatagtcctagaaggatcactcatcaaaggagtggatgtgtaacccaactggctagaaactctcagtccaaaccttgctccttccccaactaggggaccgatttggacttgtctgacagtagtgagtcactgcaggggcagccaaacatatgccccatttggaacaatcctcactctacagacaaggcaaaatgttgtattgtagttcatttgaacctggaatttagtataaaatagagtattttcatgtgttagatgtgtgtaaatatgctatcttctttaagaaattatattactctaataagatgcttttcttagattgaatattcctgtgacttaaaataagtagcttaaaaatgttgggggttggggggaagagtggtgctagccaggaagaagccagtaaacatgtaaatatagtgcaacccagtcgggcttttttttttctccaggtatcacaaagaaacccagaatgcattgttatgtagtagccatccatcttggagtctgatcctttgtattgtggatgcacacagctttacctactgtactggtagtcttcacttctatcttttaagttacaaactgttttatatatttgaatcgctagtcacttttccagtcttttggaaaaaaatttcagtccgcacaagatgatataattggagtattttaaacactagaccccaggagcttggctgaactggaaagagaacatacaaagctctgagaaatgtgttcaattgtgggattataacttctttacacttcggaaagattagcctagactaacttcattcttggcatttttattcttgttatttgaggtactttgggaagatgtgaatttcagtgttagattcatagtgataagaactgcaaacagcaatttgattctgtacttttaatttggccatctaaactgtgcagtggtctacctcttaaggataaccatgagccctgtctttgttagggtctaatcacccacctctccagggcccatcccccctcgggaaatggaaggaatgtctaaggaggaggagggctgtgtgtggcttggaatgtttttgtgaaagcatttgttgaccatgataatgcaaataacagaaggagagagagaatgaaccctttctgggtgtttcagggcaagctttacgttcctttgtaggaaggggagtaataatgtaaaacaactgacccagagaagctaaaagccactggcagcacaggctgacaaaatggaagcaaagcaagaggtggcaacaattttgaaagaccaaaagttgtgagtaactttccagtttgatagtttataaagaagttaagtaaatgtagtattggctagttactgtaagtcctcatcttctggtaggtcctgtaactctaattaggcatttgtacatttttagcagcaaaattgcctcagcagagctcccagttttattcccagttgtggctgaaaagcaaagccatggcatcagtatccttgtgcaatcggaggttgctgggctttcaccacctgtgttgttaaccttatttcctggaggaagaaacagatgaaacaagtgcctaactccctttatcaaacacagccaaggacagcctcttttaacatgtgacttcatacttgaggaaaaggagagttgacagctgtatttaaaaacccatggagccgggtgcggtggctcacgcctatgatcccagcactttgggaggccgaggcaggcggatcacaaggtcaggagattgagaccctcctggctaacaccgtgaaaccccgtctctactaaaaatacaaaaaattagccgggcgtggtggcgggtgcctgtacaggaggctgaggcaggagaatggcgtgaacccgcgaggcggagcttgcagtaagctgagatcgcgccactgccctccagcctgggcaacagagcaagactccatctcaaaaaataaatagataaaaataaaaacccatggaaatggtttaagaaaatggttctgggtacaccagaaatttgtttgcctgaagctaaagtgtgtctacaatggtacagctcttccagggacatgggaagtttatcgtgggagatatccagaacctgttttacactgggctcctactgtgtttggtgatcagaaactatagaggggtccaacccaggatttcatgtttgtatcttcataaggccatgctcctgacaggtctaggcaacctgggggatgacttaggttaatgtgctaggattgacacacctcatccagccttcttactttgtggatgggaacacttaaggaatagagagattaaatcttacacttaccccacagctggttactgacaacacaagctctagaattcatgtttgtttgtttgttttatttcaccaggctgcatgagactgaccttccggcattcttactaatagtctttctattatactattggatctttattcatccacctatacaagtaggaaataaggatgaatattcatttagaagaattaatattcatattaacacattgctctcagattattgggaattaacatcttgtaaaaactgggagcaggccaggtacggtggctaacgcctgtaatcctgacactttgggagtctgaggcgggtggttcatctgaggtcagtcgggagttcaagaccagactggccaacatggtgaaaccccgtctctactaaaaaaaaaaaatagacaaaaattagcgggggggtggtggcagggcctgtaattccagctactcaggaggctgaagcaggagaatcgtttaaacacaggaggtggaggttgcagtgagccgagattgtgccactgcactccaacctgggtgacaagagcgagactccgtctcaaaaaaaaaaaaagaaaaaaactgcagccaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttggatgatgggtccttcagtcaccttgtgagcccatgtacttattccgttgatacagcctgtgctataaacatgtggggccctccttgtgtgagctgcttgaatggccagtacccccattcttttgaatattcccaatggcagtcaatcttggcctttaagaataaatttaaatatttggaaatagtccttaggatccaagtttgatcaatgaaaaggatgcttaagctgagtttggggtcacataagaagtgcagttataaagaaataagacatgttgggcatggcagtacacacctgtagtcccagctgcttgggaagccaaggcaggaggatcacttcaacccaggagtttgagtccagcctgggtaacatagggaaaccccatctcaaaaaaacaaaacaaaggacttagtttttatgtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgatactt

SEQ ID NO: 126293 - DNA, 4655 bp, Homo sapiens
  Payload ID: 4764
  Gene Symbol: DENND6A
  Gene Name: DENN/MADD domain containing 6A
  Uniprot ID: Q8IWF6
  ENST ID: ENST00000311128
  CDS Start-End: 72-1898
ctgcgcggaggcaagcgcgctctgcggcgcggtccgctgtggaggcggcgcgaacggtcagggggcggccgatggctttgaggggccctgcgggcttggggcccggctctcgaaggccgttggacgaagcggtggcaggggccgagggccgcgaggcgccggcccttgtggcggcgggaggcgcgccagaggacgatgaagaggacgatggccgtggccggggcctgctgcgctgggacagcttctccgcctggctgcactgcgtgtgtgtggtgggcttcgacctggagctgggccaggccgtggaggtaatttatcctcagcattccaaacttactgacagagaaaaaaccaatatttgctatttgtcttttccagattcaaattcaggttgtcttggagatacccagttttgttttagatttcgacagtcttctgggaggagggtgtcgctgcattgtctcctggatcaatttgacaaagatttaccagtttacttaaagaaggatcctgcttatttttatggatatgtgtatttccgacaagttcgagataaaactctaaaaagaggctactttcagaagtccttggttttgatcagcaaactaccttatattcatttttttcacactgtgctcaaacagatagcaccagagtattttgaaaagaatgaaccttatttggaagcagcttgtaatgatgttgatcgatggcctgccccagtgccagggaaaacattacacctgccaatcatgggggtggtaatgaaggtacggattcccacatgtcatgacaagcctgggacaactcaaatagtgcagttaactcagcaggtggacacaaatatatctgttattttacctactgttcatgaggtggatattttcaggtgtttctgcccagttttccttcatagtcagatgctctgggagctggtgctgttgggggagccccttgtggttatggcgccatcaccatcggaatcatcagagactgtattggcacttgttaactgtatttctccattaaagtacttcagtgatttccgaccttatttcactattcatgatagtgaattcaaagaatatactacccgtacccaagctccgccctcagttatattaggagtaaccaaccctttttttgctaagacactccagcactggccacacattattcgaataggagaccttaaacctacaggtgaaattcctaagcaggttaaagtgaaaaaactgaagaatctaaagactctggattccaaacctggagtttatacttcatataagccatatttaaatagagatgaagagatcataaaacaattacagaagggtgtacaacagaaacgtccttctgaggctcaaagtgttattcttcgacgctattttttggaactgacacaaagtttcatcattccattagaaagatatgtggcaagcttgatgcctttgcagaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaaattggaggcactccatctagaagctctttgtgaagaggacttacttctctggatccagaaacacacagaagtagaaacagtagaccttgtcttgaagctgaaaaataagctgttgcaggctgatcgagagcacttacctgtgaaacctgacactatggaaaagttacggacacacatagatgccattatcttagcattgccagaggacttgcaaggcatactgctcaaaacgggcatgacatgatatttgccaagattttccagccaaaaaggattatgcatcatgaagcatactgacatttcaaccagacgcacaaaggagatctctcagtggcagcggagtggaaaattgccatgaatgctagttacagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgggccatcagtattagtgatttcatactgcagtgctggcattgcagatatttttttaaattggtgctgctttgcccaatcatgttaaaactcagggggatataaaaataacattcacactggctatcttcttaagaacagaaagactgaactgtcctatggttagaaggaattgatgcttatgtagtgccttctgttgtcctacatgtttcacagttcagctgctagtcttgaagcttttccttagcttcattatgatacgtaattttataaggtattctgttgagtgatcattgtttaaaaaaaaagtttcttgctacccattgtgtttattaatagacatgatgggtttttttcagttgtcatatagattttcattattttcccttccattttcaaaatttaatgttaccagtttctccaaagacaagaaggcatctagtattaatgatggaagagtttattttctcttaccctttactaatttaaacattaggctgggtgtggtggctcacgcctgtaatcctagcactttgggaggccaaggtggacaggtcacttaaggtcgagagtccaagaccagcctggccaacatggtgaaaccccgtctctagtaaaaatacaaaaattagccaggcatggtggcacgcgcctgtaatcccagctacttgggaggctgagatgtgagaatcacttgaacctgggaggcggaggttgcagtgagctgagattacacccctggactccagcttgggtgacacagtgagactgtgtctcaacaaaaataaaaaattaaataaatactaatttaaatattattaaatgtttaaactaatgaacttggctgcttttcaaagacattttaattataaatctcataatcagctatttttttaaactgaactattcttatttcaaaggcattcatgagttttttatgtgatacttatttgagtgatgataagattgatttctggcattatttgtttggtagcgttttatttttcccaacattaatgtttcttaaaacacttttcctactattgtttgacatgggaactttcgcctgagtcactgtcatggttagcttttgttgttgttgtttttgtttctgttttgtttaaacaatactaccttgccaaaaatagaagaatgtgatttggtagagtagggttgtttggtttgtgtttgaataagagtatcctacagaagccactttttttttttttgagatggagttttgctcttgttgcccaggctggagtgcaatggcgcaatctcggctgactgcaacctccacctcccgggtgcaagtgattgtcctgcctcagcctcctgagtagctgggattacaggtatgtgccaccacgcctggctaattttgtatttttagtagagatggggtttctccatgttggtcaggctggtctcaaactcccgacctcaggtgatccgcccgcctcggcctcccaaagtgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaatgcctagtgccttctatttacagtgaaaaagaggttttgtgaaggcatttatggtcattaccaaaaactaaattaaaggccttggattttaaa

SEQ ID NO: 126294 - DNA, 503 bp, Homo sapiens
  Payload ID: 4764
  Gene Symbol: DENND6A
  Gene Name: DENN/MADD domain containing 6A
  ENST ID: ENST00000477344
  CDS Start-End: 1-503
tgatcgatggcctgccccagtgccagggaaaacattacacctgccaatcatgggggtggtaatgaaggtggacacaaatatatctgttattttacctactgttcatgaggtggatattttcaggtgtttctgcccagttttccttcatagtcagatgctctgggagctggtgctgttgggggagccccttgtggttatggcgccatcaccatcggaatcatcagagactgtattggcacttgttaactgtatttctccattaaagtacttcagtgatttccgaccttatttcactattcatgatagtgaattcaaagaatatactacccgtacccaagctccgccctcagttatattaggagtaaccaaccctttttttgctaagacactccagcactggccacacattattcgaataggagaccttaaacctacaggtgaaattcctaagcaggttaaagtgaaaaaactgaagaatctaaagactctggattccaaacctg

SEQ ID NO: 126295 - DNA, 406 bp, Homo sapiens
  Payload ID: 4764
  Gene Symbol: DENND6A
  Gene Name: DENN/MADD domain containing 6A
  ENST ID: ENST00000471531
  CDS Start-End: 1-376
tgaggctcaaagtgttattcttcgacgctattttttggaactgacacaaagtttcatcattccattagaaagatatgtggcaagcttgatgcctttgcagaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaaattggaggcactccatctagaagctctttgtgaagaggttcgaaaactgtgtgtttgtgtaatgattaacaactgttgaaaataaagataattatgcttagaagttgaa

SEQ ID NO: 126296 - DNA, 4939 bp, Homo sapiens
  Payload ID: 4765
  Gene Symbol: DENND6B
  Gene Name: DENN/MADD domain containing 6B
  Uniprot ID: Q8NEG7
  ENST ID: ENST00000413817
  CDS Start-End: 73-1830
gactgttctgaggagcggcccggacgcgcgccgcccccgcccgcgtttccccggcaacccgcggccgccgccatggacgcgctgttgggcacagggcctcgccgggctcgcggctgcctgggcgcggctggacccacgtcttcaggtcgcgcggcgcggaccccggcggcgccctgggcgcgcttctccgcctggctggagtgtgtgtgcgtggtcaccttcgacctggagctgggccaggcgctggagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcacctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcggagatggtgctggccttgaccagctgcctgcagcccctcaggttctgctgcgacttccgtccctacttcaccatccatgacagcgagttcaaggagttcaccacacgcacgcaggccccaccaaacgtggtcctgggagtcacaaaccctttctttatcaaaacactccagcactggccccacatcctccgagtcggggagcccaagatgtcaggagacctgcctaagcaagtcaagctgaaaaagccttcaaggttgaagaccctggacaccaagccaggcctctacaccgcttacacggcccacctccaccgcgacaaggcgctgctcaaacggctgctcaagggcgtgcagaagaagcggccgtcagatgtgcagagcgccctgctgcggcggcacctcctggagctcacccagagcttcatcatccccctggagcactacatggccagcctcatgcccctgcagaagagcatcacgccctggaagactcccccccagatccagcccttcagccaggatgacttcctgcgtagcctggagcatgctgggccccagctcacctgcatcctcaagggcgactggctgggtctctacaggcggtttttcaagtccccccattttgatggctggtaccggcagcggcacaaggagatggccctgaagctggaggccctgcacctggaggctatctgtgaggcgaacatcgagacctggatgaaagacaagtccgaggtggaggtcgtggacctggtcctgaaacttcgtgagaagctggtgcgggctcagggccaccagctccctgtgaaggaggctacgctgcagcgggcacagctgtacatcgagacggtcatcggctccctgcccaaagacctgcaggctgtcttgtgccctccctagaacaaagccaagggccacggtcccagggccctaggtctgcctgagcctcccactccccagtggtggcggcactgggccaagcacacgctccccttccttggccccccgcccagactgcaggctccccttcctgcaccaccattgtctcagcagtaaaggcgacatttggaaccacagcatggccttgaccataggggttcctcgcaggcagagccttgcctcctcctgggtcccacctggcctctgcagaccttaggctgggacgggggcggggacaggctgggagcccttgctgatgtgggtgcgtctaccgtctgcccctcccggtgcccatctgttggcccccgacccccctgcgctgtgtgtgatgcttccctcagcccaacaggctgcccaggacaggagggaccctctcctgacacagcccccgtcttgtctggggatgggaggctattttgcatatagtcatcaacttgagaaagggagagaccactttgcagtgtgaagagctctgctcaccacccctggtgctcctctggacacccacctgcttggggctgtggtttgttgggaggtaggggttgggcagggggctgtgtgcagcccagcacctctgctaggagagctggctcagcctggctctcggagagccacagcaccttcctggctcccagtcctggagcccccaccaggcaccagctccgtgcgtcccttctgggaggtggacagggctcctgttgtccaagtgtgtccgtccatcccccacatgcagcccaaggggctctggacttcggcctgaccctgcctctggctggagcctgcatgtctccctttccttggtaaggggtgaacgtccctaagagccacctctgggttgtatgctccccccgtgacacctgcaggcactgaggccggtgaggtacggtgttgaccctgcacagcacacagtgacggtactgtcagggctccggacagccaagccctgctcagcatcacgcactgtgtgcccgggagcaggtcccctgaccactcagaccctcagactcctcatctgagcgagccagccatgcagatgcccgacagggtgctgggagggccactcatggagactgggctttgtaccctgtgaggccgggcgggtgctggccaggggacacagggctgggggagggactttttctttttttttctttttgaaatggagtctcgctctgttgcccaggctggagtgcagtggcatgatctcggctcactgcaagctctgcctcccgggttcacgccattctcctgcctcagcctcccgagtagctgggactacaggcacccaccactgcgcttggttaattttttgtatttgtagtagagacagggtttcaccatgttagccaggatggtctcgatctcctgacctcgtaatccgcccgcctcggcctcccaacgtgctaggattacaggcatgagccaccgcgcccggccgggacttttctttttcttctgaggcccccattcagtccgaggaatgtagccttcattcagcgcaacgtactgtttgtgttctcattggtgctctcagacctccagccaggtggtggagagcgagcactgccagccacttcagtgcaggatgtgactgagccacaaggacagcggggtcaggtgtccgggcgccaggtagttctcagaacttggtacatgtcaacttgtccagcccaactgcagcccaggacagcctgtccctgttcccattctacagacaagacgcggaggcagccgggagggtgaccaaggggagctgttaagccccagatgtctggtgcagggtccaaggatgtgaccacatgaaacagaacacatagaggccgaggtggcaaacctgttctgtggcagggacaagccggggacccgagggtgagaaaggtcctggccccaaatgcagcttgggcctcctgactgtagcacagggggaccagcctccccactgagggcttggtctctagagggtctgcagagatgctggcacctcttgtgtgggcagcttgaatgctgacctccataagatggggcctggggggccagtacaggccctgccatcagctgccctccaccagggccctctgcaaaagccttatgctggtgaccagccccctgaggaccaccacttcaaggtgtcggggcagcttgggaagacaacccacctctctcacaactgtgaccccactttggggagcgcaccccaaggaccgtggcagcatgtgcttccccacagcacagtctcgcctcacttggctttctgagggctgccgcacagcacagagggctgcagacccacatggctgcaggggaggggcttcaggctggtctctgaggagcccccagggaccctggccactgtgtatccagaaatgcacaagcagatttccctggagggctctggtgaggccacatagtggcgtgtgaagggggaacttgaggggggaaccgggctgggtggccagcattgccctgggcagaagctaaggctaaggtggggggtagtgtcccagcccctcttcctcagggcctgtccccacctgtgcagaagaggcctggggtggaatgtggcctggggtggatgggtgggggctgggcgtggagacctgccagctccatctgtccggatgcctcttgtggcccccccagtgtcagggccgctctgagttggctgagcctctgtccagggctaggccatggccctccccgccccacgcactccaggccaggggcagtcagtgaagaggcaggaaggtccagacagctctacccctggccagagtgccagcccccgcaggcaagagggcttgctgggcagaacttagttggcgagggtgaggactgctgtggtcacaggcctcccgaaggacagggaccacagaacctagagggtgggaagggctgggagcaggtctggagtggggctcggggctgagggtgcacacagggggcctgctcagggacaggaaggacagctgctcaccctcaagcttcctgctggctatttaaagactcccttttagtctagaacagtggccttcccacagttttggtattaaaatgtccttttgtgactgga

SEQ ID NO: 126297 - DNA, 920 bp, Homo sapiens
  Payload ID: 4765
  Gene Symbol: DENND6B
  Gene Name: DENN/MADD domain containing 6B
  ENST ID: ENST00000433760
  CDS Start-End: 27-920
ctgctgggacggtcacagtccagcagatgctgtcgaggggtgtcgcctcctcggacagatggtgtcaccaagcactctgtcttcctctgcagctggtgtatccgaacgacttccggctcacagacaaggagaaaagcagcatctgctacctgtcttttcccgactcgcactcaggctgccttggagacactcagttcagcttccgcatgcgccagtgtggagggcagaggagcccctggcatgccgacgacaggcactacaacagcagggcccctgtggcactgcagagggagccggcacactacttcggctacgtgtacttcaggcaggtgaaggacagctctgtgaagaggggctacttccagaaggccctagggtccagccccaccggccgccacccagggagttcagtgttgggttttctcctgtctaataattctggggtccaagtcaggcgttcctggggcagctgtcctgtgaagttggtgggacgtgctaccctgggccagctccagtctttggtgctggtgtcccgcttgccctttgtccggctgttccaagcgctgctaagcctcatcgcccccgagtactttgacaagctggcgccctgcctggaagcagtgtgcagtgagatcgaccagtggccggcgcctgcacctgggcagaccctgaacctacctgtcatgggcgttgttgtccaggtgcgcatcccatccagggtggacaagtccgagtccagtcctccgaagcagtttgaccaagagaacctgctgccagccccagtggttcttgctagcgtccacgagctggacctgttcaggtgcttccggcctgtgctgactcatatgcagacactgtgggagctcatgctcctcggggagcccctgctagtcctggcaccctcgcccgacgtgtcctcg

SEQ ID NO: 126298 - DNA, 2769 bp, Homo sapiens
  Payload ID: 4766
  Gene Symbol: DENR
  Gene Name: density-regulated protein
  Uniprot ID: O43583
  ENST ID: ENST00000280557
  CDS Start-End: 187-783
ctcgcgacatccgcccagcggcggccggaatctcgcgataaaggctcattgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatatatatacatacacatatatgtatacatatatacacatatatgtatacatatatacacatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgccaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaacccgtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgtataa

SEQ ID NO: 126299 - DNA, 1052 bp, Homo sapiens
  Payload ID: 4766
  Gene Symbol: DENR
  Gene Name: density-regulated protein
  ENST ID: ENST00000455982
  CDS Start-End: 137-619
gtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcacctcccaagtaggtgggattacaggcgcccgccaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggta

SEQ ID NO: 126300 - DNA, 4573 bp, Homo sapiens
  Payload ID: 4767
  Gene Symbol: DTL
  Gene Name: denticleless E3 ubiquitin protein ligase homolog (Drosophila)
  Uniprot ID: Q9NZJ0
  ENST ID: ENST00000366991
  CDS Start-End: 315-2507
cgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttg

SEQ ID NO: 126301 - DNA, 4471 bp, Homo sapiens
  Payload ID: 4767
  Gene Symbol: DTL
  Gene Name: denticleless E3 ubiquitin protein ligase homolog (Drosophila)
  ENST ID: ENST00000542077
  CDS Start-End: 339-2405
gttacgcatgcgccctggtcaccccgcggtttgtccgcgcctctgctaccccctgcgcaggcgctcaaggagctcttggactccaggttcccgcggctgggagaaaaggaggcggggatccgaagggggaaatgactctgaggcgcccggacgtcgctcggaagccaatcagagagcgtgacgtcagtttggcgcggagtttggcggccggggcttacagtggcgggagttggaggcgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttaccttatctgatgtccttttctgagctttttgcattacctagaagcagtctacaaaaaagaactatagtagtcaagaatcccttctacttgttcattaaaatgtttattcccaaagttataatctatttcaagctgaaagagcttttaataaaaaacatcttgcttg

SEQ ID NO: 126302 - DNA, 2634 bp, Homo sapiens
  Payload ID: 4768
  Gene Symbol: DMP1
  Gene Name: dentin matrix acidic phosphoprotein 1
  Uniprot ID: Q13316
  ENST ID: ENST00000282479
  CDS Start-End: 100-1593
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccgggaaattctattcttgggataaataatagtaaattctataggattcaatacttagtttgcaaaagcactttgaaattatggcacagtgagttgttttggataagaaaatctttttctcccaattaatttaccaattcatcatttttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaa

SEQ ID NO: 126303 - DNA, 2682 bp, Homo sapiens
  Payload ID: 4768
  Gene Symbol: DMP1
  Gene Name: dentin matrix acidic phosphoprotein 1
  Uniprot ID: Q13316
  ENST ID: ENST00000339673
  CDS Start-End: 100-1641
tgggcatagatttcctctttgagaacatcaacctgatttttgagactttttgaaaaaattctttgtgaactacggagggtagaggtatcacacccaactatgaagatcagcatcctgctcatgttcctttggggattatcctgtgctctcccagtaaccaggtatcaaaataatgaatctgaggattctgaagaatggaagggtcatttggctcaggcaccaacaccacccttggagagcagtgagtcatcagaaggcagtaaagttagctcagaggaacaggcaaatgaagaccccagtgacagcactcagtcagaggagggcctgggctctgatgatcatcaatacatttataggctagctggtggcttctccaggagcacaggaaaaggaggagatgataaagatgacgatgaagatgacagtggagatgacacctttggtgacgatgacagtggcccagggcccaaagacagacaagaaggaggaaactccagactgggaagtgatgaggactctgatgacaccatacaagccagtgaagagagtgccccacaagggcaagacagtgcccaagataccaccagtgagagcagggaacttgacaatgaggaccgggtggacagcaagcctgagggaggtgactccactcaagagagtgagagtgaagagcactgggtgggaggtggcagtgatggggagagcagccatggagacggctccgagttggacgatgagggaatgcagagtgatgacccagagagcatcaggagtgaaaggggaaactccagaatgaacagtgcaggcatgaaatcaaaagaatctggagaaaacagtgagcaagcaaacactcaagattcaggtggcagccaattgctggagcatcccagtaggaaaatttttaggaagtctcgcatctcagaggaagatgacagaagcgagcttgatgacaacaacacaatggaagaagtcaagagtgactctacagaaaacagcaactccagagacactggcctcagccaacccaggagagacagcaagggtgactctcaagaagacagcaaggagaatctgtcccaggaagagagccaaaacgtagatggtcccagcagtgagtccagccaagaggccaacctgtcatctcaagagaacagcagtgagtctcaggaagaggtggtgagtgagtccaggggagataaccccgaccccacaactagttatgtagaagaccaggaagacagtgactccagcgaggaggacagctcgcacacactctcccactcaaaaagtgaatccagagaggagcaagcagacagcgaatccagtgagagcctcaacttctcagaggaaagcccggagtcccctgaggatgagaacagctccagccaggagggcctccagtctcacagcagctcagcagagagtcagagcgaggaaagccattctgaggaagacgacagtgactctcaagacagcagcagatccaaagaagatagcaactccacggagagcaaatcaagcagtgaggaagatggccagttgaaaaacattgagatagagagccggaaattaacagttgatgcctatcacaacaaacccattggggaccaagatgacaatgactgccaagacggctattagcatcagctgtcctaagaagcagttgtcacataaaggagtcttagggacttgaaaatgtatcatgataactataatttattgatgttttgatcaaaagaataaccagatgccatatttttcctgaaaggaattgctggacattacacttgtttttagggtgtcatcatttcacagaggtttaaatactgtggagtgacaccagaacacagccaaagaggctagaagcaagaaaggatctgcatgataactttgcagctgagatagttcctaattcatcaacgtaacaaacaaagctattgggtgtccatgatataccaggcactatgctaggtgttgagaatgtaaagcaggttaagacttgtttcttgctcctgaggagcgtatagaaggacccacaaagctacagagttaaagagggatatgtataagagaaacaagaattgttacaacccagtatggtgagtgccaagacagagagctatgaacacgatatctatctgggaacactgagaagggtgaccaatgcgttggagaacgagggagggcttcatagcagaagacattggagttggaaggttgcatagggtttcctcattggagaccgggaaattctattcttgggataaataatagtaaattctataggattcaatacttagtttgcaaaagcactttgaaattatggcacagtgagttgttttggataagaaaatctttttctcccaattaatttaccaattcatcatttttttttttttgtagaactcccataaacatcaccttactaatcactggtgatgataagaaggattgggtcaggaagagtgggagaaagaaattcctctttacgtagatactttttagctttattttttctaaaatcagtttgcgtgcaatgctagaaaaaaactgttctctgagtcctttacagagcaaaattctgtatgtaagattcaattgatttttgacaaataccatttgaaatattacctcaacataaaatacttgttttgtaataaagattataatacccagaagaaa

SEQ ID NO: 126304 - DNA, 4281 bp, Homo sapiens
  Payload ID: 4769
  Gene Symbol: DSPP
  Gene Name: dentin sialophosphoprotein
  Uniprot ID: Q9NZW4
  ENST ID: ENST00000282478
  CDS Start-End: 34-3939
tacagccattgattattattattcctaaagaaaatgaagataattacatatttttgcatttgggcagtagcatgggccattccagttcctcaaagcaaaccactggagagacatgtcgaaaaatccatgaatttgcatctcctagcaagatcaaatgtgtcagtacaggatgagttaaatgccagtggaaccatcaaagaaagtggtgtcctggtgcatgaaggtgatagaggaaggcaagagaatacccaagatggtcacaagggagaagggaatggctctaagtgggcagaagtaggagggaagagtttttctacatattccacattagcaaacgaagaggggaatattgagggctggaatggggacacaggaaaagcagaaacatatggtcatgatggaatacatgggaaagaagaaaacatcacagcaaatggcatccagggacaagtaagcatcattgacaatgctggagccacaaacagaagcaacactaatggaaatactgataagaatacccaaaatggggatgttggcgatgcaggtcacaatgaggatgtcgctgttgtccaagaagatggacctcaagtagctggaagcaataacagtacagacaatgaggatgaaataattgagaattcctgtagaaacgagggtaatacaagtgaaataacacctcagatcaacagcaagagaaatgggactaaggaagctgaggtaacaccaggcactggagaagatgctggcctggataattccgatgggagtcctagtgggaatggagcagatgaggatgaagacgagggttctggtgatgatgaagatgaagaagcagggaatggaaaagacagtagtaataacagcaagggccaggagggccaggaccatgggaaagaagatgatcatgatagtagcataggtcaaaattcagatagtaaagaatattatgaccctgaaggcaaagaagatccccataatgaagttgatggagacaagacctccaagagtgaggagaattctgctggtattccagaagacaatggcagccaaagaatagaggacacccagaagctcaaccatagagaaagcaaacgcgtagaaaatagaatcaccaaagaatcagagacacatgctgttgggaagagccaagataagggaatagaaatcaagggtcccagcagtggcaacagaaatattaccaaagaagttgggaaaggcaacgaaggtaaagaggataaaggacaacatggaatgatcttgggcaaaggcaatgtcaagacacaaggagaggttgtcaacatagaaggacctggccaaaaatcagaaccaggaaataaagttggacacagcaatacaggtagtgacagcaatagtgatggatatgacagttatgattttgatgataagtccatgcaaggagatgatcccaatagcagtgatgaatctaatggcaatgatgatgctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcagacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagtgacagcagcaacagcagtgatagtagtgacagtagtgacagcagcaatagcagtgagagcagtgatagtagtgacagcagtgatagtgacagcagtgatagtagtgacagcagtaatagtaacagcagcgatagtgacagcagcaacagcagcgatagcagtgacagcagcaacagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcaacagcagtgatagcagcaacagcagtgatagcagtgatagcagtgacagcagtgatagcgacagcagcaatagcagtgacagcagtaatagtagtgacagcagcgatagcagcaacagcagtgatagcagcgacagcagcgatagcagtgacggcagtgatagcgacagcagcaatagaagtgacagtagtaatagtagtgacagcagcgatagcagtgacagcagcaacagcagtgacagcagtgatagcagtgacagcaacgaaagcagcaatagcagtgacagcagtgatagcagcaacagcagtgatagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcagtgacagcagcaacagcagtgacagcagtgatagcaatagcagcgacagcagtgacagcagcaacagcagcgatagcagtgacagcagtgatagcagtgacagcagtgacagcagtgatagcagcaacagcagtgatagcagtgacagcagtgacagcagtgatagcagtaatagtagtgacagcagcaatagcagtgacagcagcaacagcagtgacagcagcgatagcagtgacagcagcgatagcagtgacagcagcgatagcagtgacagcagtgacagcagcaatagcagtgacagcagtgacagcagcgacagcagtgatagcagtgacagcagtgacagcagcgacagcagtgatagcagtgaaagcagtgatagcagtgacagcagcaatagcagtgacagcagcgatagcagcgacagcagcgacagcagcgatagcagtgacagcagcgatagcagtgacagcagtgacagcagcaatagcagtgacagcagtgacagcagcgacagcagtgatagcagtgacagcagcaacagcagtgacagcagtgacagcagtgaaagcagcgacagcagtgacagcagcgacagcagtgacagcagcgatagcagcgacagcagcgacagcagcgatagcagtgacagcagcaatagcagtgatagcagcgacagcagtgatagcagtgacagcagcgacagcagcgatagcagcgacagcagcgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctgacagcaatgatgagagtgacagccagagcaagtctggtaacggtaacaacaatggaagtgacagtgacagtgacagtgaaggcagtgacagtaaccactcaaccagtgatgattagaacaaaagaaaaacccgtaagattccttttgtgaaaagtttggtaatgggataggaaaaaaagatttccaagaaagtaaagaaaggggagaaataaacataagacgtatgtaaacaaaaacaactgggggaatcaaatcaaacagttggattcagaaccaagacctaactcctgcagagacagactctgaatgcatgacctttggtacatgcctgttaatattcatgttctgaaaatattttgttaaaagtgtaaatctaaacataaaagaacaattaaaatattctttaatacttcacacagaaacctcaagtaatcactacatgataacttcaatttaag

SEQ ID NO: 126305 - DNA, 4331 bp, Homo sapiens
  Payload ID: 4769
  Gene Symbol: DSPP
  Gene Name: dentin sialophosphoprotein
  Uniprot ID: Q9NZW4
  ENST ID: ENST00000399271
  CDS Start-End: 121-4026
atgcaaaagtccaggacagtgggccactttcagtcttcaaagagaaagataagaaattctggattttcaaaatccttttgaagccttttaagccattgattattattattcctaaagaaaatgaagataattacatatttttgcatttgggcagtagcatgggccattccagttcctcaaagcaaaccactggagagacatgtcgaaaaatccatgaatttgcatctcctagcaagatcaaatgtgtcagtacaggatgagttaaatgccagtggaaccatcaaagaaagtggtgtcctggtgcatgaaggtgatagaggaaggcaagagaatacccaagatggtcacaagggagaagggaatggctctaagtgggcagaagtaggagggaagagtttttctacatattccacattagcaaacgaagaggggaatattgagggctggaatggggacacaggaaaagcagaaacatatggtcatgatggaatacatgggaaagaagaaaacatcacagcaaatggcatccagggacaagtaagcatcattgacaatgctggagccacaaacagaagcaacactaatggaaatactgataagaatacccaaaatggggatgttggcgatgcaggtcacaatgaggatgtcgctgttgtccaagaagatggacctcaagtagctggaagcaataacagtacagacaatgaggatgaaataattgagaattcctgtagaaacgagggtaatacaagtgaaataacacctcagatcaacagcaagagaaatgggactaaggaagctgaggtaacaccaggcactggagaagatgctggcctggataattccgatgggagtcctagtgggaatggagcagatgaggatgaagacgagggttctggtgatgatgaagatgaagaagcagggaatggaaaagacagtagtaataacagcaagggccaggagggccaggaccatgggaaagaagatgatcatgatagtagcataggtcaaaattcagatagtaaagaatattatgaccctgaaggcaaagaagatccccataatgaagttgatggagacaagacctccaagagtgaggagaattctgctggtattccagaagacaatggcagccaaagaatagaggacacccagaagctcaaccatagagaaagcaaacgcgtagaaaatagaatcaccaaagaatcagagacacatgctgttgggaagagccaagataagggaatagaaatcaagggtcccagcagtggcaacagaaatattaccaaagaagttgggaaaggcaacgaaggtaaagaggataaaggacaacatggaatgatcttgggcaaaggcaatgtcaagacacaaggagaggttgtcaacatagaaggacctggccaaaaatcagaaccaggaaataaagttggacacagcaatacaggtagtgacagcaatagtgatggatatgacagttatgattttgatgataagtccatgcaaggagatgatcccaatagcagtgatgaatctaatggcaatgatgatgctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcagacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagtgacagcagcaacagcagtgatagtagtgacagtagtgacagcagcaatagcagtgagagcagtgatagtagtgacagcagtgatagtgacagcagtgatagtagtgacagcagtaatagtaacagcagcgatagtgacagcagcaacagcagcgatagcagtgacagcagcaacagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcaacagcagtgatagcagcaacagcagtgatagcagtgatagcagtgacagcagtgatagcgacagcagcaatagcagtgacagcagtaatagtagtgacagcagcgatagcagcaacagcagtgatagcagcgacagcagcgatagcagtgacggcagtgatagcgacagcagcaatagaagtgacagtagtaatagtagtgacagcagcgatagcagtgacagcagcaacagcagtgacagcagtgatagcagtgacagcaacgaaagcagcaatagcagtgacagcagtgatagcagcaacagcagtgatagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcagtgacagcagcaacagcagtgacagcagtgatagcaatagcagcgacagcagtgacagcagcaacagcagcgatagcagtgacagcagtgatagcagtgacagcagtgacagcagtgatagcagcaacagcagtgatagcagtgacagcagtgacagcagtgatagcagtaatagtagtgacagcagcaatagcagtgacagcagcaacagcagtgacagcagcgatagcagtgacagcagcgatagcagtgacagcagcgatagcagtgacagcagtgacagcagcaatagcagtgacagcagtgacagcagcgacagcagtgatagcagtgacagcagtgacagcagcgacagcagtgatagcagtgaaagcagtgatagcagtgacagcagcaatagcagtgacagcagcgatagcagcgacagcagcgacagcagcgatagcagtgacagcagcgatagcagtgacagcagtgacagcagcaatagcagtgacagcagtgacagcagcgacagcagtgatagcagtgacagcagcaacagcagtgacagcagtgacagcagtgaaagcagcgacagcagtgacagcagcgacagcagtgacagcagcgatagcagcgacagcagcgacagcagcgatagcagtgacagcagcaatagcagtgatagcagcgacagcagtgatagcagtgacagcagcgacagcagcgatagcagcgacagcagcgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctgacagcaatgatgagagtgacagccagagcaagtctggtaacggtaacaacaatggaagtgacagtgacagtgacagtgaaggcagtgacagtaaccactcaaccagtgatgattagaacaaaagaaaaacccgtaagattccttttgtgaaaagtttggtaatgggataggaaaaaaagatttccaagaaagtaaagaaaggggagaaataaacataagacgtatgtaaacaaaaacaactgggggaatcaaatcaaacagttggattcagaaccaagacctaactcctgcagagacagactctgaatgcatgacctttggtacatgcctgttaatattcatgttctgaaaatattttgttaaaagtgtaaatctaaacataaaagaacaattaaaatattctttaatacttcacacagaa

SEQ ID NO: 126306 - DNA, 2716 bp, Homo sapiens
  Payload ID: 4770
  Gene Symbol: DCK
  Gene Name: deoxycytidine kinase
  Uniprot ID: P27707
  ENST ID: ENST00000286648
  CDS Start-End: 398-1180
acccgactccggaacctcttcccgcgccctgcccgggcgcctggctgcttggggtagaggccttccgccacacgcgcggccccgccccggccttcacgtgacctggcgtgcggagcgcgcacgcgggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgaccagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaa

SEQ ID NO: 126307 - DNA, 2614 bp, Homo sapiens
  Payload ID: 4770
  Gene Symbol: DCK
  Gene Name: deoxycytidine kinase
  ENST ID: ENST00000504952
  CDS Start-End: 199-1152
gcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaagtcttgctccgtcgcccaggctggagtgcaatggcacaatcttggctcactgccatctccacctcccaggttcaaccagttctgcctcagcctcctaagtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgaccagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaa

SEQ ID NO: 126308 - DNA, 428 bp, Homo sapiens
  Payload ID: 4770
  Gene Symbol: DCK
  Gene Name: deoxycytidine kinase
  ENST ID: ENST00000509617
  CDS Start-End: 384-428
gaggacaatcagaggcgatgtggaaacttctgtcttgtaatcacaggagtgaaggtgtcgggcaggctgagttaacagctgaacagaaacctacctacccaacgtgctaacttctatacagcatggtcgtgcatccaaatcaaatggaaagcggtatgggagatctggaaaggcctcctgtgggtggcatctgactacctaaattcccatcccagtttcacttactgactttgacacttggaacaagcagcctctcagtgcctgttttcccactggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagc

SEQ ID NO: 126309 - DNA, 2401 bp, Homo sapiens
  Payload ID: 4770
  Gene Symbol: DCK
  Gene Name: deoxycytidine kinase
  ENST ID: ENST00000504730
  CDS Start-End: 199-798
gcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgaccagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaa

SEQ ID NO: 126310 - DNA, 2683 bp, Homo sapiens
  Payload ID: 4770
  Gene Symbol: DCK
  Gene Name: deoxycytidine kinase
  ENST ID: ENST00000503359
  CDS Start-End: 274-420
gggaacccgcgctggaggcgggcgagggccgaggggcagctagggagcgcggcttgaggagggcggggccgccccgcaggcccgccagtgtcctcagctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcggtaaggagcctccggaaatgtgggacgcaaggctggggtgtcgcggcagtggctgaagcttcccttcgccgcatctctctgcagcaactcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgaccagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattatttatttgtcatgactcaaaa

SEQ ID NO: 126311 - DNA, 1144 bp, Homo sapiens
  Payload ID: 4771
  Gene Symbol: DGUOK
  Gene Name: deoxyguanosine kinase
  Uniprot ID: Q16854
  ENST ID: ENST00000264093
  CDS Start-End: 86-919
aacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaa

SEQ ID NO: 126312 - DNA, 880 bp, Homo sapiens
  Payload ID: 4771
  Gene Symbol: DGUOK
  Gene Name: deoxyguanosine kinase
  Uniprot ID: Q16854
  ENST ID: ENST00000348222
  CDS Start-End: 86-655
aacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattgctgtgggaaagtccacgtttgtgaagttactcacgaaaacttacccagaatggcacgtagctacagaacctgtagcaacatggcagaatatccaggctgctggcacccaaaaagcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaa

SEQ ID NO: 126313 - DNA, 703 bp, Homo sapiens
  Payload ID: 4771
  Gene Symbol: DGUOK
  Gene Name: deoxyguanosine kinase
  Uniprot ID: Q16854
  ENST ID: ENST00000418996
  CDS Start-End: 37-306
tcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagtta

SEQ ID NO: 126314 - DNA, 1029 bp, Homo sapiens
  Payload ID: 4771
  Gene Symbol: DGUOK
  Gene Name: deoxyguanosine kinase
  Uniprot ID: Q16854
  ENST ID: ENST00000629438
  CDS Start-End: 86-355
aacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtttgtttgaagagactgtaccagagggccagggaggaggagaaaggaattgagctggcctatctagagcagctgcatggccaacacgaagcctggcttattcacaagacaacgaagctccactttgaggctctgatgaacattccagtgctggtgttggatgtcaatgatgatttttctgaggaagtaaccaaacaagaagacctcatgagagaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttct

SEQ ID NO: 126315 - DNA, 1757 bp, Homo sapiens
  Payload ID: 4772
  Gene Symbol: DOHH
  Gene Name: deoxyhypusine hydroxylase/monooxygenase
  Uniprot ID: Q9BU89
  ENST ID: ENST00000250937
  CDS Start-End: 178-1086
gcggcaggtgaagcggtggtggcagaggcgcctgcggttactggccgggccgacgggtcctgagtctccagagctcggtgaggcgtcccggaggcggcgatcacggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcatggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgagtgggtcaggtagggcacaggggccagggagggacaagcagacctcagagcgctgcccagatggaatattaaattatttttgccaagca

SEQ ID NO: 126316 - DNA, 2031 bp, Homo sapiens
  Payload ID: 4772
  Gene Symbol: DOHH
  Gene Name: deoxyhypusine hydroxylase/monooxygenase
  Uniprot ID: Q9BU89
  ENST ID: ENST00000427575
  CDS Start-End: 453-1361
agccagcccaggcagggcgctgaatcggcacaaaccagtctcacttcttgtaccgcagtggggaggttggagagaattttttcccatgaaagggcatacgttgcccgtccccttccccgaagaacgcactaggaatactgttcctgcgtttgcatgagctgtggcaccagcaccgactcagccttccgggcctccctcatgcacggagcctctcactaggtctcacccgcggctgcgttggtgccgtccggcacggtcacgtgggcgagaaaatggcggcccccagaccgcactgcgggcgtcgcggcaggtgaagcggtggtggcagaggcgcctgcggttactggccgggccgacgggtcctgagtctccagagctcggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgccccagctggcggccgccctggcccgatgcaccgagaaccccatggtgcggcacgagtgcgcggaggccctgggcgccattgcccggcccgcctgcctggccgcgctgcaggctcacgcggacgacccagagcgcgtggtgcgtgagagctgcgaggtggctctggacatgtatgagcacgagaccgggcgggccttccagtacgcggacggcctggagcagctgcgcggggccccctcctagggccccaccctcacccggagctcccggaggactcttgagggccgctcctcccccgcagagctttggcgtctaaaccgggtgtgtgtaaatcggtgtcatcgcttgtgtcttgctgggcgcatggttgctgtccccctcctccgtctgggaccgaggagctgccgttgtgctgtgactccctgagtcccctgactgctcctcggggcctggcgcagggctgtagcgtggaagtttccaggcttggggtgggactctgcgggaggctctgggatgcccggctcaggacaggggaggattgcgagggaagccaggggaggatcgcgagggaagccaggggaggatcgcgagggaagccaggggaggatcgcgagggaagccaggggaggatcgcgagggaagccaagggaggatcgcgaggggagccaggggaggatcgcgagggaagccaggggcagagctggggctctgggaagaggctgacgttatggtggcttcagcttcactaggaatgggacacagggtctgggggcctctgactcccccaccccgaggcctgggtagggacagggtggtggtccctgagtgggtcaggtagggcacaggggccagggagggacaagcagacctcagagcgctgcccagatggaatattaaattatttttgccaagc

SEQ ID NO: 126317 - DNA, 1095 bp, Homo sapiens
  Payload ID: 4772
  Gene Symbol: DOHH
  Gene Name: deoxyhypusine hydroxylase/monooxygenase
  ENST ID: ENST00000592858
  CDS Start-End: 426-1095
gcacaaaccagtctcacttcttgtaccgcagtggggaggttggagagaattttttcccatgaaagggcatacgttgcccgtccccttccccgaagaacgcactaggaatactgttcctgcgtttgcatgagctgtggcaccagcaccgactcagccttccgggcctccctcatgcacggagcctctcactaggtctcacccgcggctgcgttggtgccgtccggcacggtcacgtgggcgagaaaatggcggcccccagaccgcactgcgggcgtcgcggcaggtgaagcggtggtggcagaggcgcctgcggttactggccgggccgacgggtcctgagtctccagagctcggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtctgcactgtgggagcgccctcttccgccacgaggtcggctacgtcctgggacagctgcagcacgaggcggcggtgcccc

SEQ ID NO: 126318 - DNA, 703 bp, Homo sapiens
  Payload ID: 4772
  Gene Symbol: DOHH
  Gene Name: deoxyhypusine hydroxylase/monooxygenase
  ENST ID: ENST00000587122
  CDS Start-End: 1-586
cgattccgccctgctcaagcacgagctggcctactgcctgggccagatgcaggatgcccgcgccatccccatgctggtggacgtgctgcaagacacccgtcaggagcccatggtgcgccatgaggcaggggaggccctgggggccatcggggacccggaagttctggagatcctgaagcagtattcctcggaccccgtcatcgaggtggccgagacctgccagctggccgtgcgcaggctggagtggctgcagcagcacggcggggagccggcggcgggaccctacctctccgtggaccctgccccgccggctgaggagcgtgacgtggggcgcctgcgggaggcgctgctggatgagtcccggccgctcttcgagcgataccgcgccatgttcgccctgcgcaacgcgggaggcgaggaggccgccctggcgctggccgagggtgaggaggggcttctggggtggggtcctgggcagtgcctcgctgtgaggttcagtgatggcatctgtgcagtggggccgcggcctgcccccgggaacggcatcccgggcctggccccaagcatttcccatggggcctcttaagaacccgtgcaagcgtccctcttggtccccatagctcccagcttttcccgcccccatagctgcggtcagttcccccgggcatccctaatcactggggctgggggcaggggtgtcttc

SEQ ID NO: 126319 - DNA, 1363 bp, Homo sapiens
  Payload ID: 4773
  Gene Symbol: DHPS
  Gene Name: deoxyhypusine synthase
  Uniprot ID: P49366
  ENST ID: ENST00000210060
  CDS Start-End: 137-1246
tccggtctttcgcccaaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcct

SEQ ID NO: 126320 - DNA, 1090 bp, Homo sapiens
  Payload ID: 4773
  Gene Symbol: DHPS
  Gene Name: deoxyhypusine synthase
  Uniprot ID: P49366
  ENST ID: ENST00000351660
  CDS Start-End: 6-974
ggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcc

SEQ ID NO: 126321 - DNA, 603 bp, Homo sapiens
  Payload ID: 4773
  Gene Symbol: DHPS
  Gene Name: deoxyhypusine synthase
  ENST ID: ENST00000595100
  CDS Start-End: 73-471
gtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatg

SEQ ID NO: 126322 - DNA, 895 bp, Homo sapiens
  Payload ID: 4773
  Gene Symbol: DHPS
  Gene Name: deoxyhypusine synthase
  ENST ID: ENST00000595912
  CDS Start-End: 103-522
ctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcact

SEQ ID NO: 126323 - DNA, 285 bp, Homo sapiens
  Payload ID: 4773
  Gene Symbol: DHPS
  Gene Name: deoxyhypusine synthase
  ENST ID: ENST00000600639
  CDS Start-End: 1-83
gaccagacgaggctgtctcctggggcaagatccgggtggatgcacagcccgtcaaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcct

SEQ ID NO: 126324 - DNA, 540 bp, Homo sapiens
  Payload ID: 4773
  Gene Symbol: DHPS
  Gene Name: deoxyhypusine synthase
  ENST ID: ENST00000593423
  CDS Start-End: 99-371
aatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccat

SEQ ID NO: 126325 - DNA, 498 bp, Homo sapiens
  Payload ID: 4773
  Gene Symbol: DHPS
  Gene Name: deoxyhypusine synthase
  ENST ID: ENST00000600451
  CDS Start-End: 1-169
cgcggacctgacccagagccgccgcccacttaccagctgcaccattttcctgggatatacatccaacctcatcagttcaggcatccgtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagtcccgcacttacagacggctcgctgggcgacatgatcttcttccattcctacaagaacccgggcctggtcctggacatcgttgagggtgaggcgctagggccacag

SEQ ID NO: 126326 - DNA, 677 bp, Homo sapiens
  Payload ID: 4773
  Gene Symbol: DHPS
  Gene Name: deoxyhypusine synthase
  ENST ID: ENST00000598850
  CDS Start-End: 1-205
catgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatgcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctgg

SEQ ID NO: 126327 - DNA, 553 bp, Homo sapiens
  Payload ID: 4773
  Gene Symbol: DHPS
  Gene Name: deoxyhypusine synthase
  ENST ID: ENST00000598246
  CDS Start-End: 1-478
gatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttcca

SEQ ID NO: 126328 - DNA, 1172 bp, Homo sapiens
  Payload ID: 4773
  Gene Symbol: DHPS
  Gene Name: deoxyhypusine synthase
  Uniprot ID: P49366
  ENST ID: ENST00000594424
  CDS Start-End: 94-1077
agatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctaga

SEQ ID NO: 126329 - DNA, 605 bp, Homo sapiens
  Payload ID: 4773
  Gene Symbol: DHPS
  Gene Name: deoxyhypusine synthase
  ENST ID: ENST00000597152
  CDS Start-End: 191-605
tgattcttggtgtgggggcgggttctagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgagg

SEQ ID NO: 126330 - DNA, 464 bp, Homo sapiens
  Payload ID: 4773
  Gene Symbol: DHPS
  Gene Name: deoxyhypusine synthase
  ENST ID: ENST00000600864
  CDS Start-End: 1-348
gtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgagggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtcc

SEQ ID NO: 126331 - DNA, 1176 bp, Homo sapiens
  Payload ID: 4773
  Gene Symbol: DHPS
  Gene Name: deoxyhypusine synthase
  ENST ID: ENST00000601537
  CDS Start-End: 95-928
ttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctacttttt

SEQ ID NO: 126332 - DNA, 1133 bp, Homo sapiens
  Payload ID: 4773
  Gene Symbol: DHPS
  Gene Name: deoxyhypusine synthase
  ENST ID: ENST00000601639
  CDS Start-End: 42-440
ggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatgg

SEQ ID NO: 126333 - DNA, 595 bp, Homo sapiens
  Payload ID: 4773
  Gene Symbol: DHPS
  Gene Name: deoxyhypusine synthase
  ENST ID: ENST00000596162
  CDS Start-End: 50-595
gggcgggagtttctgtcctgggaaggggattttgcactctggtagttacatgctgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcc

SEQ ID NO: 126334 - DNA, 1124 bp, Homo sapiens
  Payload ID: 4773
  Gene Symbol: DHPS
  Gene Name: deoxyhypusine synthase
  ENST ID: ENST00000614126
  CDS Start-End: 6-1118
ggcgcatggaaggttccctggaacgggaggcgccacgggggcgcgccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatggtgagtgggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggct

SEQ ID NO: 126335 - DNA, 1290 bp, Homo sapiens
  Payload ID: 4774
  Gene Symbol: DNTTIP1
  Gene Name: deoxynucleotidyltransferase, terminal, interacting protein 1
  Uniprot ID: Q9H147
  ENST ID: ENST00000372622
  CDS Start-End: 69-1058
agtgacgtcacggcgccactttccggccggtgacagagtccagcggagttgtgggggccgggggcgccatgggagccactggcgacgccgagcagccgcggggacctagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaa

SEQ ID NO: 126336 - DNA, 591 bp, Homo sapiens
  Payload ID: 4774
  Gene Symbol: DNTTIP1
  Gene Name: deoxynucleotidyltransferase, terminal, interacting protein 1
  ENST ID: ENST00000415790
  CDS Start-End: 157-591
atcgtcccaccccaaggcgggagagatggtgacggatctgagaagcagggatgtccaggtttaacttcatacccaccctccacctccaccccaccccagtgtcacaggccgcagtgacatttgttccgttggtccccacagaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatg

SEQ ID NO: 126337 - DNA, 473 bp, Homo sapiens
  Payload ID: 4774
  Gene Symbol: DNTTIP1
  Gene Name: deoxynucleotidyltransferase, terminal, interacting protein 1
  ENST ID: ENST00000449078
  CDS Start-End: 1-453
gacgccgagcagccgcggggacctagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggtgcgtggtggatcaagttatcatggccccatttggtatcatggggatgagcaccctgctgcctccctgcctctctggtgtggtcaggaagcatgacatcaggtctataaatgact

SEQ ID NO: 126338 - DNA, 930 bp, Homo sapiens
  Payload ID: 4774
  Gene Symbol: DNTTIP1
  Gene Name: deoxynucleotidyltransferase, terminal, interacting protein 1
  ENST ID: ENST00000435014
  CDS Start-End: 1-698
tgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaaggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaa

SEQ ID NO: 126339 - DNA, 1073 bp, Homo sapiens
  Payload ID: 4774
  Gene Symbol: DNTTIP1
  Gene Name: deoxynucleotidyltransferase, terminal, interacting protein 1
  ENST ID: ENST00000456939
  CDS Start-End: 1-841
gaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaa

SEQ ID NO: 126340 - DNA, 2199 bp, Homo sapiens
  Payload ID: 4775
  Gene Symbol: DNTTIP2
  Gene Name: deoxynucleotidyltransferase, terminal, interacting protein 2
  ENST ID: ENST00000359208
  CDS Start-End: 15-1820
agggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaactcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaa

SEQ ID NO: 126341 - DNA, 5897 bp, Homo sapiens
  Payload ID: 4775
  Gene Symbol: DNTTIP2
  Gene Name: deoxynucleotidyltransferase, terminal, interacting protein 2
  Uniprot ID: Q5QJE6
  ENST ID: ENST00000436063
  CDS Start-End: 59-2329
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaacaccatcatctaaattaatttaccatagactggccctgttcatacaggaatttgtatttggaaaaagttgatttgagaatcgattacatgcccttagaaaataggggtgtctaaaagacccaccctggtgtagactctttatgggaaaaaaggaaaaaaaatctcaaccattttaagataactgatggtttgtaaagttttcaatgcttagttatttaaagaaaatttaattaaaagataggaagtataaagtttgctaacatgttcaaagaactttaaaaaatgatcaaagatatataaacattattgtaattaataggtagttttatgtgtgtatgtgtgtgtgtgtctgtgtaggggacgggagatggtagagaggcaatgccctatagttagctataaaattcagatccagaaagttgggatacaaagatatgaagaatatgacctagaaagcttgggcagaggagctgttttccttgcttggcaactgaaacagggaggaataattggtttttatctagatttaagtgttgtggtccaagtaaaacaggattaaactataatttaagttggccagggtttcttcgaagttaacccagcttacctcttctccagtggtacagtatgcaccctggctaagctggtttctggcacccaaggagtgttggtcatttctgttgatacttggtgagttgtagcttcctttatgttactattcactttacctctatttttccagcatactgcttccttgagatatcagcaaatatgaaatcttttttttttttaataatagttttggggtacatgtgtagaacatgcaggttacataggtatacacgtgccatggtggtttgctgcacccatcaacctatctacattaggtatttctcctagtgctatccctcccctagtcccccacccacaacaggccccagtgtgtgatgttcccctccctgtgtccatgtgttctcattgtttacctcccacttacgagtaagaacatgcagtgtttggttttctgttcttgtgttagttttctgttcttgctgagatgatttccagcttcagccatgtccctgcaaaggacatgaactcatgcttttttatggccacatagtattccatggtgtatatgtgccacattttctttatccagtctatcattcatgggcatttgggttggttccaagtcttttctattgtgaacagtgccacagtaaacatacttgtgtatgtgtctttatagtagaatgatttataatcctttgggtatatacccagtaatgggattgctgggtcaaatggtatttctggtcctagatccttgcggaatcaccacactgtcttccacaatggttgaactagtttacactcccaccaacagtgtaaaagtgttcctagttctccatatcctctccagcatctgttgtttcctgactttttaatgattgccattctaactggcaatgagatggtatctcattgtggttttgatttgcatttctctaatgagcagtgataatgagcgttttttcatgtttgttggctgcataaatgtcttcttttgagaagtgtctgttcatatccttcacccactttttgatggggttttttcttgtaaatttgtttaagttctttgtagattctggatattagccctttgtcagatggatagattacagaaattttctcccattctgtagattgcctgtgcactctgataatagtttcttttgctgtgcagaaactctttagtttaattagatcccacttgtcaattttgccttttgttgccattgcttttggtgttttagtcatgcagtctgcccatacctatgtccaaaatctcatatttactgcttggagtcaaaagctagtaatagcagaactgacaataacattcatagttggagttagggaagcatctatgtctgttctcttttattttaaaaaaaaactacttttgtttctggaatactatgttttgccttctactggataaaataaggacccagtatgagagaattgtatcctttagtgcttctggccttctacaaatacctggatatttaaataatggatgaagttatgttttgctttttaataagcaagtcttttgagaaacaggttttactgactttggcctgtgtcactaaactcagttcacctactggaacttttttttttttttttgagacgtctcactccatcacccaggttggagtgcagtggtgccatctcagctcactgcaacctccgcctcccaagttcaagcgattatcatacctcagcctgccaagtagctgggactactgggcatgccattatgcccagctaacttttgtatttttagtagagatggggttttgccatccttacctcaagtgatccacccgcctcggcctcccaaagtgctgggattacaggtgtgagccaccatgcccagccaactggaactatttgaaggctttataccagaaaagtataaagaatccaaagggctgccacagtcaggtgtgctggtgaaagagaccttcaagatacccctgagaagatcttgaaagatttcgaaaagaatgctgtatttatacaccatctggctccaagatgctttttttttttttttttttgagagacggactctcgctctgtcgcccaggctggagtgtagtggcatgatcttggttcactgcaacctccgcctcccgggttcaagcaattctgcctcagcctcccaagtacctgggattaacaggcacccaccaccacacccggctaatttttgtatttttagtagagacggggtttcaccatgttggccaggctggtcttgaacttctgacctcaggtgatccaccggcctcagcctcccaaagtgctgggattacaggcaggagccaccacgtctggcccaaaatgttcttaaaacaaagtagatgctgtaagactacagttgataaagttgggctctgggctaggttcttagcatccaacacaatcagttctgtgttcagtgttctgctgtatgataaaccaactgctctagagaaacaccaatattcctcttctgaaacctgggaaaatgtcttttttgggtcccataactagatgtcacaaaaggagtggggagtggggaggctatataaaaaagttcaacaaaaccttagtaactggtatacattaataggatcccattcttagaaacagcaagttaaagaaaataccataatgggaaaaaaaagttaacatttctgagagatgtaccaggtattcagtctctcaggcagtgacaacttgttcagaataattacctacaatagatcccaaaccattgaaaaatgcctaattgtttacttaatggaatttgtacttactatttaattagatgaatatctttattgaaagttttcagtaagggttgcaacaaaaagggctttctaattaaccaattccccaagcatctgtctaattaaaatgtaaagtgcaattat

SEQ ID NO: 126342 - DNA, 499 bp, Homo sapiens
  Payload ID: 4775
  Gene Symbol: DNTTIP2
  Gene Name: deoxynucleotidyltransferase, terminal, interacting protein 2
  ENST ID: ENST00000528680
  CDS Start-End: 17-499
cgagggagccggaaagatggtggttaccagatctgcacgggctaaggccagcatccaagccgcgtcggctgaaagttccgggcaaaagtgtgttttctctggtttgcagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtg

SEQ ID NO: 126343 - DNA, 4200 bp, Homo sapiens
  Payload ID: 4776
  Gene Symbol: DNASE1
  Gene Name: deoxyribonuclease I
  Uniprot ID: P24855
  ENST ID: ENST00000246949
  CDS Start-End: 3210-4058
cagaaaagagatccacgagggagaagtgagagtgctggagactccacaagccacaggctgcaggggcaggatggcttcttagaaggtgaaatgattgttctgggaatctatcagaggaagacatagaggctccagacggttgaaggcccaacagtgatcccagacgggccccatgtcagaccaggctcctccagggctgtgctgccctcaccaaagcccgtcctgagggcagccacacagcaggcagcactcgccatttgtacaagcgaggcccaagttccagccttccttctggcaggtagaggaagcaggggcactatgcctgggagttcctgaaagcagatggggcagcatttggtcaagagccaggaggggatgacagaccagaggggaaccctcgtcccacgtgctgagcacacgtagggggttgggcacttgctctgtgagctataattggtgtccctgtgccccgccggaagctgcaccaggcagtttcttggtggaggacagtggccgccctctagctttactcccttccccgtgatgggtcgctgtcagatgtgtgtccaggaaaggcaaacaccaaaggcagaggactagtccctacaccgaatactccggtggccttgcttgggggctgggttttgacgtgctggaggctgtcctagacttagagattaaaaacagggaagaaccattgctgaaacctttggaaaagcctgcaatggggcctctggcagcctgaggagtggtggtgtttccatctggtagacgccgtctcaataggagggacagatgagtgcaccagtgctgccagccagaggcgtctgttggcgtgtctttatggaatggggtgccagtcttgtggagggtggtttaccttcctgtttctagtccccactgggcctgccttctgcttcatggccagctggccagaccgagcactttcctgactttcgaccttggcccctgctgactcttgccgttgaggcctcctgcagaccccatttgtattcatttcctgcagttctcatacctgaatcccgcctggacttctgccaagccttccaggccctcctcccccagggggaccacagatgctacgtgcagggctgtccttggagggccagcacagccccttccaagtgggcaagacccaggggtggctcaaaagatagctgtgccctagccctggaacctctgaatgttgatttttgtagcaaaaaaggacttgcagatgtgagtaaaggctgttgagataaggacatcctccctgctctctgggaggaccccaaatgcaggtgcacagatcttaagaagaagaggcagagactggggtgatgcagccacaactaaggaaagccaaggattgctggcagcctgcagaaactggagggcaaggagcatcccccaaccgcccggagcctccaggaggcgcaaggtcctactgactccctgacttcagacgtccagtctccggaattttgagaggatccatttctgttattttaagcaaccaaacttgtggtagtttcaccagtctcaggaaatgaatacgaatggaaagtcaaagattccaagaaatgagtggcggggtgcggtggctcacacttgtaatcccagcatttgcgggaagattgcttgggctcaggacttggagaccttgtgtctgtgagaaacttaaaaaataggctgggtgcgatggctcacgcctgtaatcccagcactttgggaggccgaggcaggcggatcacaaggtcacgagtttgagaccagtgtgaccaacatggtgaaaccctgtctctactaaaaatacaaaaattagccgggtgtggtggtgcgtgcctgtaatcccagctactcgggaggctgaggcagaagaattgcttgaacccaggaagcagaggttgcagtgagccgagatagtattactgcactccaggctgggcagcagagcaagattccgcctcaaaaaaaaaaaaaaaaaaaaaaaaaaaaaaaaaaactgagcatggtagcatgcacctgtggtcctggctacgccggaggattgcctgaagccaggagttcaagaccagtctggacaaaagagcaagaccccatctctaccaaaaaaatttaaaaattagccaggcatggtgccgtacccatagtcttagctactcaggaggctgaggagggaggattatctgagccctggcggttgaggctataatgagccatgattgtgccactgcactccagccttggcaacacagtgtgagaccctgtctcaaaaacaataaaaacccaaaacaaaagaaccaagaaattactggacctgaggcctggcctttagctgctgccctgcccttgtgacctggtcactcgggatcccctgggcctaaacacacagcctattgtctacctcaagaaggctccccactgcttggctggcaattggggtgggctttgcaggccccacctgtcctggccccacggcgctggtgctgcaggcccccaccactgcttgttccgagctccccagcctcctgcagagttgcctgcacctgatggcgatgaatcaggaaggcaggcgtgtcctgggccacagagcagtcatggctgtcagccaccagggggctccatttgcaactttggatgtggctttggcctctttgtccaaagtgaccttggggcccccagacaagagacagggagactggagcccagccccaccctcccgcacatacctggcccatccctgccctatcctggaagatgggggccaccacacgtgcaagggacacgggataggaacctttggccttgttatcagacattttaaaactaagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtca

SEQ ID NO: 126344 - DNA, 8552 bp, Homo sapiens
  Payload ID: 4776
  Gene Symbol: DNASE1
  Gene Name: deoxyribonuclease I
  Uniprot ID: P24855
  ENST ID: ENST00000407479
  CDS Start-End: 185-1033
ctcctgcccaggacccgaggagccggccaccgttcagaaggccccagcttgaaggcctggagagccgcccagcagcacaacacagggaagcttggggagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcaggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaa

SEQ ID NO: 126345 - DNA, 2732 bp, Homo sapiens
  Payload ID: 4776
  Gene Symbol: DNASE1
  Gene Name: deoxyribonuclease I
  ENST ID: ENST00000570769
  CDS Start-End: 1638-1898
ggccagcgcttccggtcggcaggaggcggggcgaggcggaagcggcgcttgcttcaggtggagtctgttagtttttgagaaagagttagggcgagtttaaggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcagtgaccacaatatgaatgggaacagcaagatggcaaaagcttgctgagtggtacagcgccagcctgggtagtggcctccccagcaagttgcatgtcactagcttcctgtggctgtcactcctgggcccaggcacctccgaagatcagcacctcctcatgggctcaagcgaggacaggagcccgtcacccatgagctctcaagggcagagccactgtcctgtctcgatggctccaccgtgactccagtggactttggacagtggggagcaggcccaacagggccactcggatgtggtcactctggatttgggtggatcagcaccaagctagactcatccccagcccccaggtgctgttgctgctcctgcgtgaggccccatccacagctgcagctgtggcagggtggctagtggtggccagcatggccctgctgcagctccacgctgtggggggcgtggccctgaccagcagccacccctccatgtgggccacaggggaggagcttaggaagccgccttggcaaggttccgcaggctctgcgtctggtgtggaagagctcacggggaagcactcctgcccaggacccgaggagccggccaccgttcagaaggccccagcttgaaggcctggagagccgcccagcagcacaacacagggaagcttggggaggtttaatttaacctgagaaggctgcagatcctcggggttggtgtaaaaacacctcatcctgatctgagaaggcggtcagcttttctcctcgttgccgttggctgccagcacccattctctgtggatgtgaaaatcccagaagggctgggcttccttcttgggcattccccaggcctatctccagagtggggcccagcatgggaggattgtaccccactcactcccctgatgtggggcttggacctacagctcgacagcacccatggaatgtgggcagaagcgacagcagccagctccgccttggccttagggcggcacgtgttctgcttgtgccctgggagcctccaccttccacactgtgggaagagggtgcccagggagctgcagtctctccagcccagccccaggacgaggcccaggcagcagagccaccccagcagacctggcagtgtgagagaaatgcatgtgtatacactgagtttgcaggtggctgttacatggcagcattgactgacacagacagaaaagagatccacgagggagaagtgagagtgctggagactccacaagccacaggctgcaggggcaggatggcttcttagaagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagatcctgagccgctatgacatcgccctggtccaggaggtcagagacagccacctgactgccgtggggaagctgctggacaacctcaatcagtgggtgacagtggcagggtcataggaagggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggtgaggccctcccaggggcagtgggcaccagcggcctccgcatgtcccagggccacaggcagcgtttcctggtaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtca

SEQ ID NO: 126346 - DNA, 766 bp, Homo sapiens
  Payload ID: 4776
  Gene Symbol: DNASE1
  Gene Name: deoxyribonuclease I
  ENST ID: ENST00000570807
  CDS Start-End: 1-272
atcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagggagtgtgcctcacacgacgtggctgtctccacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggg

SEQ ID NO: 126347 - DNA, 528 bp, Homo sapiens
  Payload ID: 4776
  Gene Symbol: DNASE1
  Gene Name: deoxyribonuclease I
  ENST ID: ENST00000570664
  CDS Start-End: 1-327
aaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggctgcctatggcctgagtgaccaactggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtca

SEQ ID NO: 126348 - DNA, 1377 bp, Homo sapiens
  Payload ID: 4776
  Gene Symbol: DNASE1
  Gene Name: deoxyribonuclease I
  ENST ID: ENST00000571460
  CDS Start-End: 380-562
taagtgcaaacgtgattatcaggtgcagtttttacagcagcaagaaacctgtgcttacagaaagaaacacgtgctagcaacccacctatgcggaaagccacacagagccattgttttctgcactctcaggtgacggctcacatttgccccagggaaggtcacagctgcctgaacttttaaaactcccagacacgcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactgttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctg

SEQ ID NO: 126349 - DNA, 580 bp, Homo sapiens
  Payload ID: 4776
  Gene Symbol: DNASE1
  Gene Name: deoxyribonuclease I
  ENST ID: ENST00000576792
  CDS Start-End: 1-219
tccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggtaggctcagcccagaccctgtgcccacttgcctgcaggcccaagccatcagtgaccactatccagtggaggtgatgctgaagtgagcagcccctccccacaccagttgaactgcaggaagagaggacccatcctgccacaggacccagaaaaaaagcccaacacacactcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagca

SEQ ID NO: 126350 - DNA, 613 bp, Homo sapiens
  Payload ID: 4776
  Gene Symbol: DNASE1
  Gene Name: deoxyribonuclease I
  ENST ID: ENST00000575479
  CDS Start-End: 1-197
ccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggtatgtgtcctcccttgcacagccacatgaggatgggacacaggagctcaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgct

SEQ ID NO: 126351 - DNA, 541 bp, Homo sapiens
  Payload ID: 4776
  Gene Symbol: DNASE1
  Gene Name: deoxyribonuclease I
  ENST ID: ENST00000572237
  CDS Start-End: 1-227
agcgctacctgttcgtgtacaggcctgaccaggtgtctgcggtggacagctactactacgatgatggctgcgagccctgcgggaacgacaccttcaaccgagagccagccattgtcaggttcttctcccggttcacagggagtgtgcctcacacgacgtggctgtctccacagaggtcagggagtttgccattgttcccctgcatgcggccccgggggacgcagtagccgagatcgacgctctctatgacgtctacctggatgtccaagagaaatggggcttggagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggtatgtgtcctcccttgcacagccacatgaggatgggacac

SEQ ID NO: 126352 - DNA, 582 bp, Homo sapiens
  Payload ID: 4776
  Gene Symbol: DNASE1
  Gene Name: deoxyribonuclease I
  ENST ID: ENST00000570376
  CDS Start-End: 187-369
gcactgcctgtgcaggatccggagcccagcagcactgccagggccttgaagtgcttcttcagagacctttcttcatagactacttttttttctttaagcagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgc

SEQ ID NO: 126353 - DNA, 965 bp, Homo sapiens
  Payload ID: 4776
  Gene Symbol: DNASE1
  Gene Name: deoxyribonuclease I
  ENST ID: ENST00000576050
  CDS Start-End: 243-425
gactcattccaggttccgcaggctctgcgtctggtgtggaagagctcacggggaagcactcctgcccaggacccgaggagccggccaccgttcagaaggccccagcttgaaggcctggagagccgcccagcagcacaacacagggaagcttggggagcaaaaggagaaaattgtcatcaaaggatattccagattcttgacagcattctcgtcatctctgaggacatcaccatcatctcaggatgaggggcatgaagctgctgggggcgctgctggcactggcggccctactgcagggggccgtgtccctgaagatcgcagccttcaacatccagacatttggggagaccaagatgtccaatgccaccctcgtcagctacattgtgcagggatgcaccagacacctatcactacgtggtcagtgagccactgggacggaacagctataaggagcgctacctgttcgtgtacaggcctgaccaggtgtctgcggtggacagctactactacgatgatggctgcgagccctgcgggaacgacaccttcaaccgagagccagccattgtcaggttcttctcccggttcacagaggtcagggagtttgccattgttcccctgcatgcggccccgggggacgcagtagccgagatcgacgctctctatgacgtctacctggatgtccaagagaaatggggcttggaggacgtcatgttgatgggcgacttcaatgcgggctgcagctatgtgagaccctcccagtggtcatccatccgcctgtggacaagccccaccttccagtggctgatccccgacagcgctgacaccacagctacacccacgcactgtgcctatgacaggatcgtggttgcagggatgctgctccgaggcgccgttgttcccgactcggctcttccctttaacttccaggctgcctatggcctgagtgaccaactggtatgtgtcct

SEQ ID NO: 126354 - DNA, 1130 bp, Homo sapiens
  Payload ID: 4777
  Gene Symbol: DNASE2B
  Gene Name: deoxyribonuclease II beta
  Uniprot ID: Q8WZ79
  ENST ID: ENST00000370662
  CDS Start-End: 529-990
catgcacagttaaaaatggactttctttcccctgtctttcatgtcacaggcttcatattgatggggaagctgcctattaggggaatagatgacttctcatgtgtattaatgaaagcaatgtattgcaggctgggtagctggtagaaatgttgtgggcgtttgtaagtggaagatttacgccattataaccctaatatattcctgcagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacgacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgtt

SEQ ID NO: 126355 - DNA, 1269 bp, Homo sapiens
  Payload ID: 4777
  Gene Symbol: DNASE2B
  Gene Name: deoxyribonuclease II beta
  Uniprot ID: Q8WZ79
  ENST ID: ENST00000370665
  CDS Start-End: 34-1119
atggggaaagtgtcctgctgtggcatgaaataaatgaaacagaaaatgatggcaagactgctaagaacatcctttgctttgctcttccttggcctctttggggtgctgggggcagcaacaatttcatgcagaaatgaagaagggaaagctgtggactggtttactttttataagttacctaaaagacaaaacaaggaaagtggagagactgggttagagtacctgtacctagactctacaactagaagctggaggaagagtgagcaactaatgaatgacaccaagagtgttttgggaaggacattacaacagctatatgaagcatatgcctctaagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacgacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgtttaccatttaa

SEQ ID NO: 126356 - DNA, 1955 bp, Homo sapiens
  Payload ID: 4778
  Gene Symbol: DNASE2
  Gene Name: deoxyribonuclease II, lysosomal
  Uniprot ID: O00115
  ENST ID: ENST00000222219
  CDS Start-End: 94-1176
gtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtg

SEQ ID NO: 126357 - DNA, 745 bp, Homo sapiens
  Payload ID: 4778
  Gene Symbol: DNASE2
  Gene Name: deoxyribonuclease II, lysosomal
  ENST ID: ENST00000592506
  CDS Start-End: 92-745
gaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatgacctgtactccggctggttggcagcagcccttggtaccaacctgcaggtccagttctggcacaaaactgtaggcatcctgccctctaactgctcggatatctggcaggtt

SEQ ID NO: 126358 - DNA, 2652 bp, Homo sapiens
  Payload ID: 4779
  Gene Symbol: DNASE1L1
  Gene Name: deoxyribonuclease I-like 1
  Uniprot ID: P49184
  ENST ID: ENST00000014935
  CDS Start-End: 795-1703
cttgaacgcctgacctcgtatccacccgcctcagcctcccaaagtgctgggattacaggcatgagccaccacgcccagcccataatttattgattttttaaaatttgtccagccttctattaccacgtcgaatccattagctacagccatcccatgagaagctgagtggattcagccccacctcctgctcacagaccctgtccgagcacctcatttgtcccaacagcattactgcaggacccccaggacgttggactgccagctccctgggtctcctcctctctggggcagatcctcagtcctcccttgacttcacgactgtggccagatcatgtgtggactgtccctctctttgggtctccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcatgccggacccctcccttccatcctcctctccaaagaagagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaa

SEQ ID NO: 126359 - DNA, 2249 bp, Homo sapiens
  Payload ID: 4779
  Gene Symbol: DNASE1L1
  Gene Name: deoxyribonuclease I-like 1
  Uniprot ID: P49184
  ENST ID: ENST00000309585
  CDS Start-End: 395-1303
tgtgcacggtcaggtggttcatgtactctggcggggaaggagaagtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagccctattcaggcaggagctgctcttctggggtatcgcgatccacttaaggatgaggcagacttggtgacaagctggtctgagcagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcatgccggacccctcccttccatcctcctctccaaagaagagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacc

SEQ ID NO: 126360 - DNA, 2110 bp, Homo sapiens
  Payload ID: 4779
  Gene Symbol: DNASE1L1
  Gene Name: deoxyribonuclease I-like 1
  Uniprot ID: P49184
  ENST ID: ENST00000369807
  CDS Start-End: 253-1161
ggggcgtccggcccagccaggcccttcctggccgggtggctcaggaacacagcctcttcctcttttttttcccctcctagccctattcaggcaggagctgctcttctggggtatcgcgatccacttaaggatgaggcagacttggtgacaagctggtctgagcagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcatgccggacccctcccttccatcctcctctccaaagaagagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaa

SEQ ID NO: 126361 - DNA, 2666 bp, Homo sapiens
  Payload ID: 4779
  Gene Symbol: DNASE1L1
  Gene Name: deoxyribonuclease I-like 1
  Uniprot ID: P49184
  ENST ID: ENST00000369808
  CDS Start-End: 809-1717
gtggggcgtccggcccagccaggcccttcctggccgggtggctcaggaacacagcctcttcctcttttttttcccctcctagccctattcaggcaggagctgctcttctggggtatcgcgatccacttaaggatgaggcagacttggtgacaagctggtctgagcaggtatgggagccccctggggagacggaagaagggaggaagttgccttctgcctggggagggtttgagagggagagggaagcctagggctcccaccaaggctgatattgacagccagggtttggggctgaagccaggaaccgtcgctctctctggttcttactggtagccctcatgggggtccctgacgccagagcctccaaggctgcatgtgccagcccagggctgcccacatacccatgtatatcccagaataggcaccagggtagggaacccaaactagcatgagtgacagagcaggtggtcagggagaaacagacatcaaacccagccaggagagagacaccgcaacagagagacagagaagggaaaccagagacgagagggaaagtgagacagagacggacagagcctcagagaggtaggaagtgagcccgaagggaaggtgacaggttgatagagaaaagcaggcagacagagcagaggaactcatgcctcaggatgcaaaagccacatggacagggcgtggagcaaggagccgagccctgcaaggtcagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcatgccggacccctcccttccatcctcctctccaaagaagagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaa

SEQ ID NO: 126362 - DNA, 3008 bp, Homo sapiens
  Payload ID: 4779
  Gene Symbol: DNASE1L1
  Gene Name: deoxyribonuclease I-like 1
  Uniprot ID: P49184
  ENST ID: ENST00000369809
  CDS Start-End: 631-1539
gtactctggcggggaaggagaagtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcatgccggacccctcccttccatcctcctctccaaagaagagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaagaaatggctgtaaactgagattacaaaaaaccagaggccttttgggagccacaggctgggggctggggccaacataccccagctctgggaccaaaagcctttggagtcctgtccctggatacagatgctcaggccacccacctagcactcctctcatttttgctgctcccccaaaagccagcgctgttctacaatagttcaggtcagacatctaagatccccaggccaaaccatgccacacacgtgtctgttccgaggtcttgttacaaatgaccaaaggttagcctagacctttggtcaggtggtgaaggccctgggaatgcaggttctagaaggggtgggggcatggggcccaggaggttgctagagataggaaatggggcaaatcgcaggtgacctcagcagtacctggatgattcccaccaaggaggaatggccaaaccagatgggtgagaacaagcccaatgtgatgcacacctacccttgctaaataaacgctgctggtcagcctctagcccac

SEQ ID NO: 126363 - DNA, 2665 bp, Homo sapiens
  Payload ID: 4779
  Gene Symbol: DNASE1L1
  Gene Name: deoxyribonuclease I-like 1
  Uniprot ID: P49184
  ENST ID: ENST00000393638
  CDS Start-End: 288-1196
gtactctggcggggaaggagaagtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcatgccggacccctcccttccatcctcctctccaaagaagagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaagaaatggctgtaaactgagattacaaaaaaccagaggccttttgggagccacaggctgggggctggggccaacataccccagctctgggaccaaaagcctttggagtcctgtccctggatacagatgctcaggccacccacctagcactcctctcatttttgctgctcccccaaaagccagcgctgttctacaatagttcaggtcagacatctaagatccccaggccaaaccatgccacacacgtgtctgttccgaggtcttgttacaaatgaccaaaggttagcctagacctttggtcaggtggtgaaggccctgggaatgcaggttctagaaggggtgggggcatggggcccaggaggttgctagagataggaaatggggcaaatcgcaggtgacctcagcagtacctggatgattcccaccaaggaggaatggccaaaccagatgggtgagaacaagcccaatgtgatgcacacctacccttgctaaataaacgctgctggtcagcctctagcccac

SEQ ID NO: 126364 - DNA, 942 bp, Homo sapiens
  Payload ID: 4779
  Gene Symbol: DNASE1L1
  Gene Name: deoxyribonuclease I-like 1
  ENST ID: ENST00000424626
  CDS Start-End: 632-942
tgtactctggcggggaaggagaagtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcg

SEQ ID NO: 126365 - DNA, 904 bp, Homo sapiens
  Payload ID: 4779
  Gene Symbol: DNASE1L1
  Gene Name: deoxyribonuclease I-like 1
  ENST ID: ENST00000451865
  CDS Start-End: 281-904
ggcggggaaggagaagtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctgagcagcccccagctggggcgcagcacctacatggagacgtatgtgtacttctatcggtcacacaaaacacaggtcctgagttcctacgtgtacaacgatgaggatgacgtctttgcccgggagccatttgtggcccagttctctttgcccagcaatgtccttcccagcctggtgttggtcccgctgcacaccactcctaaggccgtagagaaggagctgaacgccctctacgatgtgtttctggaggtctcccagcactggcagagcaaggacgtgatcctgcttggggacttcaatgctgactgcgcttcactgaccaaaaagcgcctggacaagctggagctgcggactgagccaggcttccactgg

SEQ ID NO: 126366 - DNA, 297 bp, Homo sapiens
  Payload ID: 4779
  Gene Symbol: DNASE1L1
  Gene Name: deoxyribonuclease I-like 1
  ENST ID: ENST00000447892
  CDS Start-End: 43-297
cagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcgggccctcaacatcagtgaccactaccccgtggaggtggagctgaagctgagccaggcgcacagcgtccagcctctcagcctcactgttctgttgctgctatcactcctgtcccctcagctg

SEQ ID NO: 126367 - DNA, 847 bp, Homo sapiens
  Payload ID: 4779
  Gene Symbol: DNASE1L1
  Gene Name: deoxyribonuclease I-like 1
  ENST ID: ENST00000432135
  CDS Start-End: 768-847
tactctggcggggaaggagaagtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagcattactgcaggacccccaggacgttggactgccagctccctgggtctcctcctctctggggcagatcctcagtcctcccttgacttcacgactgtggccagatcatgtgtggactgtccctctctttgggtctccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacagccctattcaggcaggagctgctcttctggggtatcgcgatccacttaaggatgaggcagacttggtgacaagctggtctgagcagcgcttccagagccagaactgagcccagtgagagcgcaccctggggcagcctggattcctggggtgtccccggcagccacacacagccatgcactacccaactgcactcctcttcctcatcctggccaatggggcccaggcctttcgcatctgcgccttcaatgccca

SEQ ID NO: 126368 - DNA, 238 bp, Homo sapiens
  Payload ID: 4779
  Gene Symbol: DNASE1L1
  Gene Name: deoxyribonuclease I-like 1
  ENST ID: ENST00000412184
  CDS Start-End: 51-238
ccctggggcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcgggacgtgatcctgcttggggacttcaatgctgactgcgcttcactgaccaaaaa

SEQ ID NO: 126369 - DNA, 1326 bp, Homo sapiens
  Payload ID: 4780
  Gene Symbol: DNASE1L2
  Gene Name: deoxyribonuclease I-like 2
  Uniprot ID: Q92874
  ENST ID: ENST00000320700
  CDS Start-End: 134-1033
gtgcagtcctgtgtcggacacgcccgcagcctggacccgggatccccatccccctaggatctctgagcctcgggcctctgcacccacatccaaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggccccaca

SEQ ID NO: 126370 - DNA, 1222 bp, Homo sapiens
  Payload ID: 4780
  Gene Symbol: DNASE1L2
  Gene Name: deoxyribonuclease I-like 2
  Uniprot ID: Q92874
  ENST ID: ENST00000382437
  CDS Start-End: 93-929
gcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccgcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggccccaca

SEQ ID NO: 126371 - DNA, 2194 bp, Homo sapiens
  Payload ID: 4780
  Gene Symbol: DNASE1L2
  Gene Name: deoxyribonuclease I-like 2
  Uniprot ID: Q92874
  ENST ID: ENST00000564065
  CDS Start-End: 1002-1901
ctgcctcccaggccactcctagactcacgtgcctggccgccccacccaggggcttctgccagccctggcggcgccttggtgctgtgtgggtgtcattggcatgttgaccaacagcctcctgccctgcccagctggagctgtgcccccagctgcgctgcctgaggcctgtgggtgggtgggaggaccagggacggggacagggagatctgggagcctcggcctccaccgcagggtgagcaggtggagcagcagcaggagatgctgggtagggagtgtggctggtcctacctgcgctgccttgctttccctgaagggattctgctcagggaggcagagtctaggcgacctaatttctaggggcgaggacaagaacacagccgcaccgggatgtggctgaccgtctacctccctcctagggggctggcaggggcttctgggacggttttgggacaggtctggggcaccagaaccggctcaggcaggtctcccaccccttaccctgggggtctccatgggaatgaaagccaggagttcatcaggcacccagctgagtcgagggggcgggacccagtgcagcccggcccctccctggcccaggacctcaaataccggcccctgccttggtgccagagctactgccagagggagtcagtgcagtcctgtgtcggacacgcccgcagcctggacccgggatccccatccccctaggatctctgagcctcgggcctctgcacccacatccaaggtgagtctctcggctgccctgagctggggctggatgggccggaccctccattccggctgcagcttcccgcgcagtgagaaggcagcggtccctgagagcccagcagtgccctgggagcctgcagaacgcaggggcggattccgcgtcgcactggccgtcaaggggcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggccccaca

SEQ ID NO: 126372 - DNA, 1301 bp, Homo sapiens
  Payload ID: 4780
  Gene Symbol: DNASE1L2
  Gene Name: deoxyribonuclease I-like 2
  Uniprot ID: Q92874
  ENST ID: ENST00000567494
  CDS Start-End: 109-1008
gcagtcctgtgtcggacacgcccgcagcctggacccgggatccccatccccctaggatctctgagcctcgggcctctgcacccacatccaagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggccccaca

SEQ ID NO: 126373 - DNA, 762 bp, Homo sapiens
  Payload ID: 4780
  Gene Symbol: DNASE1L2
  Gene Name: deoxyribonuclease I-like 2
  ENST ID: ENST00000569184
  CDS Start-End: 1-762
ccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattc

SEQ ID NO: 126374 - DNA, 1260 bp, Homo sapiens
  Payload ID: 4780
  Gene Symbol: DNASE1L2
  Gene Name: deoxyribonuclease I-like 2
  Uniprot ID: Q92874
  ENST ID: ENST00000613572
  CDS Start-End: 134-970
gtgcagtcctgtgtcggacacgcccgcagcctggacccgggatccccatccccctaggatctctgagcctcgggcctctgcacccacatccaaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcggcccccggcaccgcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctggctggggcatgccacctgcagaccctggctctgaggaatggcccaacagtggccccttcagggtggcagccacccttcagtgaggccccaaggcagagtcggctgggcgtggaccaggggccatggacacgtgatgtgctgctctgtacctccgttccccatctgtgggacgggctgcatccagcgacctcatggggtgttgtgagccccatgaggggtgcagggggcactgcccggcagatgtctgctcaataaatgagctgctcccggtcgggcccc

SEQ ID NO: 126375 - DNA, 1294 bp, Homo sapiens
  Payload ID: 4781
  Gene Symbol: DNASE1L3
  Gene Name: deoxyribonuclease I-like 3
  Uniprot ID: Q13609
  ENST ID: ENST00000394549
  CDS Start-End: 318-1235
agatgtcagagctggctcccggttgggatatgagtgactttgtggaggatggcgcctaaatgaggcatgccaatttctgcaccagggtgacgaacataagggctccttaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacaga

SEQ ID NO: 126376 - DNA, 2099 bp, Homo sapiens
  Payload ID: 4781
  Gene Symbol: DNASE1L3
  Gene Name: deoxyribonuclease I-like 3
  ENST ID: ENST00000483681
  CDS Start-End: 583-1449
tttcttcttgctgcttttgggtgactcagcctatgacacttttgctcctcctgaaatctccatatcttgcttttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagtgcatcttagagactggtgtttgcaagtatatggagcaggaaacttcatcccgaagatggagaccccggggctgtcagcaggcgttaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggtaaggttgccatcttgtctttctatgccattgtcctggaaagatgagttagcttgggcaacatgatgagactccatctctatgaaaaattcaaaaaaattagctgggcatggtgatgcatgcctatggtcccagctacttgggaggctgaggtgggaggatcacttgagtccaggaagcggaggttgcagtgagccaagatcgcaccactgcactccaggctgggcaacagagtgagatcctgtctcaaaaaaaaaaaaaaaaaaagatgggttgatgccaccctttgaggtcaccactgaagacacaacattgggcactagaccttgaccctcaatgcctatgattctgtgatttgaggcccctccaaaatttctgatcgagctggtcttggaatgacgcttaccagtaagtgttctgtggggtgacttcgggcatttcctctcccctccctggtcctaaatttgctcatcgctaaaatgaaagcatctcccaggcatctcctaatttccatgtctacctcccctttctccttataggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagat

SEQ ID NO: 126377 - DNA, 502 bp, Homo sapiens
  Payload ID: 4781
  Gene Symbol: DNASE1L3
  Gene Name: deoxyribonuclease I-like 3
  ENST ID: ENST00000477209
  CDS Start-End: 1-414
gcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacaga

SEQ ID NO: 126378 - DNA, 635 bp, Homo sapiens
  Payload ID: 4781
  Gene Symbol: DNASE1L3
  Gene Name: deoxyribonuclease I-like 3
  ENST ID: ENST00000461914
  CDS Start-End: 163-635
tagatgtcagagctggctcccggttgggatatgagtgactttgtggaggatggcgcctaaatgaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccacccc

SEQ ID NO: 126379 - DNA, 786 bp, Homo sapiens
  Payload ID: 4781
  Gene Symbol: DNASE1L3
  Gene Name: deoxyribonuclease I-like 3
  ENST ID: ENST00000460422
  CDS Start-End: 486-786
cagcctatgacacttttgctcctcctgaaatctccatatcttgcttttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagtgcatcttagagactggtgtttgcaagtatatggagcaggaaacttcatcccgaagatggagaccccggggctgtcagcaggcgttagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaac

SEQ ID NO: 126380 - DNA, 1321 bp, Homo sapiens
  Payload ID: 4781
  Gene Symbol: DNASE1L3
  Gene Name: deoxyribonuclease I-like 3
  Uniprot ID: Q13609
  ENST ID: ENST00000486455
  CDS Start-End: 64-891
agaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctg

SEQ ID NO: 126381 - DNA, 1705 bp, Homo sapiens
  Payload ID: 4782
  Gene Symbol: DERA
  Gene Name: deoxyribose-phosphate aldolase (putative)
  Uniprot ID: Q9Y315
  ENST ID: ENST00000428559
  CDS Start-End: 213-1169
ggtacctcgtggagaagacgggggaggggagcagcgagatttccttgcggagcaatattcctagggtacagacctcgtagcccgggcccgcgactccgccccgggagcgggcaggggcggggcgagcgctccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaataa

SEQ ID NO: 126382 - DNA, 1619 bp, Homo sapiens
  Payload ID: 4782
  Gene Symbol: DERA
  Gene Name: deoxyribose-phosphate aldolase (putative)
  ENST ID: ENST00000526530
  CDS Start-End: 393-1085
agaggtgaggtacgtggcatgggtaacacacatttcccacgtcgttagacatgtctgtgtgatgaatcaatacaggttcttccagttccaaatgtataggctggtacagaagcaattgtggtttttgcctttgaaagtaatggagtgattttgcatgaaaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaaaat

SEQ ID NO: 126383 - DNA, 814 bp, Homo sapiens
  Payload ID: 4782
  Gene Symbol: DERA
  Gene Name: deoxyribose-phosphate aldolase (putative)
  ENST ID: ENST00000524480
  CDS Start-End: 520-814
ggcgcggcgcagaggcgggcgcctaccagccggcagctccggagctgcccgcgccatgtccgcgcacaatcggggcaccgagctcgtttgtttcagagaagatgcaatttatcctgagggagaatggaaaagtccaaactttggtagattatgagagtagggttcgatgttagtgaagttttcaaggatggcatgtcaaaaccagacttcctcaggaactgcttcatgtggatatactgatgagcctcagagcatcatgtgatggtgaccagggagtgacctcaagaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatc

SEQ ID NO: 126384 - DNA, 735 bp, Homo sapiens
  Payload ID: 4782
  Gene Symbol: DERA
  Gene Name: deoxyribose-phosphate aldolase (putative)
  ENST ID: ENST00000531803
  CDS Start-End: 26-735
cggcagctccggagctgcccgcgccatgtccgcgcacaatcggggcaccgagctcgctcgctggttggaaaacccaacaacccaaaaaacaaaacccaaaacaaacaacccccaagcagaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattt

SEQ ID NO: 126385 - DNA, 1113 bp, Homo sapiens
  Payload ID: 4782
  Gene Symbol: DERA
  Gene Name: deoxyribose-phosphate aldolase (putative)
  ENST ID: ENST00000528821
  CDS Start-End: 22-222
agctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaaggtatattattgccagcaaatctttcttcagagtaaagataatgttatttataatactagttacagccacaataactgtctttatatggagaagttgtgaatgaattacctttattaagataaatgtttaatttacctttcattataaaagaacacactgatggagaaaaattgtgatgaacagaaagtgagttgtgagtgtgggagtgagtatgtgtgatcaagatgtaaactcactttatgtccttttgttaaccgaagacaattttgtcactgacaagagattcctaaatgggttctttaacgaactaattctgctgcaacacagaggctttctcacaaggtgttggccagtgaaaacaggttaatgcagaaattaaacttccttgaggaat

SEQ ID NO: 126386 - DNA, 819 bp, Homo sapiens
  Payload ID: 4782
  Gene Symbol: DERA
  Gene Name: deoxyribose-phosphate aldolase (putative)
  ENST ID: ENST00000533447
  CDS Start-End: 331-819
tgcctgacattgtgtagctgtatcaggctggctttctggaatagctcagtggccaaagattgatcacgaagggtttagagctgtgaaaatgccccagaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaaggta

SEQ ID NO: 126387 - DNA, 745 bp, Homo sapiens
  Payload ID: 4782
  Gene Symbol: DERA
  Gene Name: deoxyribose-phosphate aldolase (putative)
  ENST ID: ENST00000526521
  CDS Start-End: 83-265
ccagctggcgggaaggaggaagggccgggcgcggcgcagaggcgggcgcctaccagccggcagctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctc

SEQ ID NO: 126388 - DNA, 854 bp, Homo sapiens
  Payload ID: 4782
  Gene Symbol: DERA
  Gene Name: deoxyribose-phosphate aldolase (putative)
  ENST ID: ENST00000532964
  CDS Start-End: 22-849
agctccggagctgcccgcgccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcag

SEQ ID NO: 126389 - DNA, 1232 bp, Homo sapiens
  Payload ID: 4783
  Gene Symbol: DTYMK
  Gene Name: deoxythymidylate kinase (thymidylate kinase)
  Uniprot ID: P23919
  ENST ID: ENST00000305784
  CDS Start-End: 209-847
aggacacggctccagtggcggcgcggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcagagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgtt

SEQ ID NO: 126390 - DNA, 1089 bp, Homo sapiens
  Payload ID: 4783
  Gene Symbol: DTYMK
  Gene Name: deoxythymidylate kinase (thymidylate kinase)
  ENST ID: ENST00000400770
  CDS Start-End: 162-413
tcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcagagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaa

SEQ ID NO: 126391 - DNA, 575 bp, Homo sapiens
  Payload ID: 4783
  Gene Symbol: DTYMK
  Gene Name: deoxythymidylate kinase (thymidylate kinase)
  ENST ID: ENST00000420144
  CDS Start-End: 1-575
aaagatcaactgaaatcggcaaacttctgagttcctacttgcaaaagaaaagtgacgtggaggatcactcggtgcacctgcttttttctgcaaatcgctgggaacaagttttcattcttgtcgcccagactggagtgcaatggggcgatcttggctcactgcaacctacgcctcgcaggttcaagcgattctcctgcctcagcctctcaagtagctgtgatcacaggccgttaattaaggaaaagttgagccagggcgtgaccctcgtcgtggacagatacgcattttctggtgtggccttcaccggtgccaaggagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgag

SEQ ID NO: 126392 - DNA, 518 bp, Homo sapiens
  Payload ID: 4783
  Gene Symbol: DTYMK
  Gene Name: deoxythymidylate kinase (thymidylate kinase)
  ENST ID: ENST00000445261
  CDS Start-End: 1-511
caagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagttaggtttcctcttcattcaacacttaatgttgataatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaagg

SEQ ID NO: 126393 - DNA, 926 bp, Homo sapiens
  Payload ID: 4783
  Gene Symbol: DTYMK
  Gene Name: deoxythymidylate kinase (thymidylate kinase)
  ENST ID: ENST00000432348
  CDS Start-End: 1-304
ggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtacagggtctctgtgtcatgcaggctgagtgcagtgcgcaatcacagcttactgcagcctcgacctcccgggttcaagtgatcttcccacctcagcctcccaagtagctgcaactataggcacgttaacacacctggctaatttttgtaaaattttttgtagcgatggagtctcactattgttgcccaggctggtcttgaactcctggacccaagcagtcctcctgccttggtttcccaaagtgctgtgattagaggcatgagccaccctgcctggccttatttttttttaggagaaatgtcttgctctgttgcccaggctggaatgttgtggcatgatcacagcttactgcagccttaaactcctgggttcaagtgatcctcctgcctcagcctctggagtagctaggactacagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgaccca

SEQ ID NO: 126394 - DNA, 2147 bp, Homo sapiens
  Payload ID: 4784
  Gene Symbol: DUT
  Gene Name: deoxyuridine triphosphatase
  Uniprot ID: P33316
  ENST ID: ENST00000331200
  CDS Start-End: 94-852
ggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaactaa

SEQ ID NO: 126395 - DNA, 1935 bp, Homo sapiens
  Payload ID: 4784
  Gene Symbol: DUT
  Gene Name: deoxyuridine triphosphatase
  Uniprot ID: P33316
  ENST ID: ENST00000455976
  CDS Start-End: 150-644
agccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaa

SEQ ID NO: 126396 - DNA, 724 bp, Homo sapiens
  Payload ID: 4784
  Gene Symbol: DUT
  Gene Name: deoxyuridine triphosphatase
  ENST ID: ENST00000558472
  CDS Start-End: 61-724
tggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccaagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggag

SEQ ID NO: 126397 - DNA, 1171 bp, Homo sapiens
  Payload ID: 4784
  Gene Symbol: DUT
  Gene Name: deoxyuridine triphosphatase
  ENST ID: ENST00000558978
  CDS Start-End: 44-724
tccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaaggatatggcgaatgtgtcagtaacgtcagtaataaactattctttctttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagatta

SEQ ID NO: 126398 - DNA, 569 bp, Homo sapiens
  Payload ID: 4784
  Gene Symbol: DUT
  Gene Name: deoxyuridine triphosphatase
  ENST ID: ENST00000559935
  CDS Start-End: 157-558
ataaacactacaacgtctgacactcggtgctgaaaggaaatcgggcgcggtgtcttgcccacagcttggggagcggccccgggcgcaataactgtcaccggcgccgagatgcggttccggcgcttagggcgccgctaaactcagagcccgggagtcatggctgcgggcggtgccgccccagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagacaggatatggcgaatgtgtcagtaacgtcagtaata

SEQ ID NO: 126399 - DNA, 627 bp, Homo sapiens
  Payload ID: 4784
  Gene Symbol: DUT
  Gene Name: deoxyuridine triphosphatase
  ENST ID: ENST00000558367
  CDS Start-End: 307-627
ggtgagcggggacctgccggcgaggaggctgggaagggccggccgtccgctgccacagctagaaacagtcaccggagagatcacaggaacacactagctataaataggatttctgcctttttcgtgtttaaaattttagctttcatctttggcataaattaaatagagatttgggcaaagactgcagaataagtaaaatagctatacggtgtctagcaaggcgttactttgcaacgtttattgtgcccttcctaaatagaagatagagaggaaggcccatggtggctttcgagtggcccgagggtgatgctgtgctcaatagaaaaaccaagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgac

SEQ ID NO: 126400 - DNA, 769 bp, Homo sapiens
  Payload ID: 4784
  Gene Symbol: DUT
  Gene Name: deoxyuridine triphosphatase
  ENST ID: ENST00000558813
  CDS Start-End: 129-554
ggctgcgactgcttccgaggtcatgttcccaggacgggcgcgtcttcagggtggaagcctggcgcacgtccggagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaa

SEQ ID NO: 126401 - DNA, 1441 bp, Homo sapiens
  Payload ID: 4784
  Gene Symbol: DUT
  Gene Name: deoxyuridine triphosphatase
  ENST ID: ENST00000559540
  CDS Start-End: 43-474
ctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaaggtatgttaaatatatacattcacataattttagtgaattttcagagtcatgtatgtgtaaattaatattgactcctttaattctcattgaataagacaggatatggcgaatgtgtcagtaacgtcagtaataaactattctttctttgaagtcaaaaaaggtgatcgaattgcacagctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagatta

SEQ ID NO: 126402 - DNA, 635 bp, Homo sapiens
  Payload ID: 4784
  Gene Symbol: DUT
  Gene Name: deoxyuridine triphosphatase
  ENST ID: ENST00000559416
  CDS Start-End: 73-576
gcaataactgtcaccggcgccgagatgcggttccggcgcttagggcgccgctaaactcagagcccgggagtcatggctgcgggcggtgccgccccagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaa

SEQ ID NO: 126403 - DNA, 4586 bp, Homo sapiens
  Payload ID: 4785
  Gene Symbol: DEPDC1
  Gene Name: DEP domain containing 1
  Uniprot ID: Q5TB30
  ENST ID: ENST00000370966
  CDS Start-End: 223-1806
agctactggagccccaggacgcagccgagcggccctcgccgactccttcccgagcctggctgtggcgtcacgtgacccgcggcgcggccaatccgcgcagccctctatgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttgggcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactagaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgcttgatttttatgtcctttcctcttgccttgtattgagtttaagatctctactgattaaaactcttttgctatcaa

SEQ ID NO: 126404 - DNA, 5331 bp, Homo sapiens
  Payload ID: 4785
  Gene Symbol: DEPDC1
  Gene Name: DEP domain containing 1
  Uniprot ID: Q5TB30
  ENST ID: ENST00000456315
  CDS Start-End: 116-2551
tgctattcaaatcggcggcggggccaacggttgtgccgagactcgccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaactttgataaatgaagccatatctgagaatgtagctactcaaaaggaagtctgtcattaataaggtatttctaaataaacacattatgtaaggaagtgccaaaatagttatcaatgtgagactcttaggaaactaactagatctcaattgagagcacataacaatagatgataccaaatactttttgtttttaacacagctatccagtaaggctatcatgatgtgtgctaaaattttatttacttgaattttgaaaactgagctgtgttagggattaaactataattctgttcttaaaagaaaatttatctgcaaatgtgcaagttctgagatattagctaatgaattagttgtttggggttacttctttgtttctaagtataagaatgtgaagaatatttgaaaactcaatgaaataattctcagctgccaaatgttgcactcttttatatattctttttccacttttgatctatttatatatatgtatgtgtttttaaaatatgtgtatattttatcagatttggttttgccttaaatattatccccaattgcttcagtcattcatttgttcagtatatatattttgaattctagttttcataatctattagaagatggggatataaaagaagtataaggcaatcatatattcattcaaaagatatttatttagcaactgctatgtgcctttcgttgttccagatatgcagagacaatgataaataaaacatataatctcttccataaggtatttattttttaatcaagggagatacacctatcagatgtttaaaataacaacactacccactgaaatcagggcatatagaatcattcagctaaagagtgacttctatgatgatggaacaggtctctaagctagtggttttcaaactggtacacattagactcacccgaggaattttaaaacagcctatatgcccagggcctaacttacactaattaaatctgaattttggggatgttgtatagggattagtattttttttaatctaggtgattccaatattcagccaactgtgagaatcaatggcctaaatgctttttataaacatttttataagtgtcaagataatggcacattgactttattttttcattggaagaaaatgcctgccaagtataaatgactctcatcttaaaacaaggttcttcaggtttctgcttgattgacttggtacaaacttgaagcaagttgccttctaatttttactccaagattgtttcatatctattccttaagtgtaaagaaatatataatgcatggtttgtaataaaatcttaatgtttaatgactgttctcatttctcaatgtaatttcatactgtttctctataaaatgatagtattccatttaacattactgatttttattaaaaacctggacagaaaattataaattataaatatgactttatcctggctataaaattattgaaccaaaatgaattctttctaaggcatttgaatactaaaacgtttattgtttatagatatgtaaaatgtggattatgttgcaaattgagattaaaattatttggggttttgtaacaatataattttgcttttgtattatagacaaatatataaataataaaggcaggcaactttcatttgcactaatgtacatgcaattgagattacaaaatacatggtacaatgctttaataacaaactctgccagtcaggtttgaatcctactgtgctattaactagctagtaaactcagacaagttacttaacttctctaagccccagttttgttatctataaaatgaatattataatagtacctctttttaggattgcgaggattaagcaggataatgcatgtaaagtgttagcacagtgtctcacatagaataagcactctataaatattttactagaatcacctaggattatagcactagaagagatcttagcaaaaatgtggtcctttctgttgctttggacagacatgaaccaaaacaaaattacggacaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgcctccaccatccctaatatcttctaattggtatcatataatgacccactcttcttatgttatccaaacagttatgtggcatttagtaatggaatgtacatggaatttcccactgacttacctttctgtccttgggaagcttaaactctgaatcttctcatctgtaaaatgtgaattaaagtatctacctaactgagttgtgattgtagtgaaagaaaggcaatatatttaaatcttgaatttagcaagcccacgcttgatttttatgtcctttcctcttgccttgtattgagtttaagatctctactgattaaaactcttttgctatcaa

SEQ ID NO: 126405 - DNA, 582 bp, Homo sapiens
  Payload ID: 4785
  Gene Symbol: DEPDC1
  Gene Name: DEP domain containing 1
  ENST ID: ENST00000525124
  CDS Start-End: 481-582
gtgccgagactcgccactgccgcggccgctgggcctgagtgtcgccttcgccgccatggacgccaccgggcgctgacagacctatggagagtcagggtgtgcctcccgggccttatcgggccaccaagctgatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagca

SEQ ID NO: 126406 - DNA, 1613 bp, Homo sapiens
  Payload ID: 4785
  Gene Symbol: DEPDC1
  Gene Name: DEP domain containing 1
  ENST ID: ENST00000489862
  CDS Start-End: 1-925
gactatccaactgttgaggaaatttcttaagaatcatgtaattgaagatatcaaagggaggtggggatcagaaaatgttgatgataacaaccagctcttcagatttcctgcaacttcgccacttaaaactctaccacgaagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaataatccaacttatgttggatttgaacgagatgtattcagaacaatcgcagattattttctagatctccctgaacctctacttacttttgaatattacgaattatttgtaaacattttgggaaatttcaaggattttaggagctccataccagttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttacagactgcagtggaaaaacatcttgactacttaaaaaagggacatattgaaaatcctggagatggactatttgctcctttgccaacttactcatactgtaagcagattagtgctcaggagtttgatgagcaaaaagtttctacctctcaagctgcaattgcagaacttttagaaaatattattaaaaacaggagtttacctctaaaggagaaaagaaaaaaactaaaacagtttcagaaggaatatcctttgatatatcagaaaagatttccaaccacggagagtgaagcagcactttttggtgacaaacctacaatcaagcaaccaatgctgattttaagaaaaccaaagttccgtagtctaagataactaactgaattaaaaattatgtaatacttgtggaa

SEQ ID NO: 126407 - DNA, 2499 bp, Homo sapiens
  Payload ID: 4786
  Gene Symbol: DEPDC1B
  Gene Name: DEP domain containing 1B
  Uniprot ID: Q8WUY9
  ENST ID: ENST00000265036
  CDS Start-End: 69-1658
aaactgctgctcctccggctggcggggatcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgcca

SEQ ID NO: 126408 - DNA, 1569 bp, Homo sapiens
  Payload ID: 4786
  Gene Symbol: DEPDC1B
  Gene Name: DEP domain containing 1B
  Uniprot ID: Q8WUY9
  ENST ID: ENST00000453022
  CDS Start-End: 42-1445
atcagcgctggcgcggctgcggccgctgctgcctacgcgccatggagcatcgcatcgtggggcccgggccgtaccgagctaccaggctgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagat

SEQ ID NO: 126409 - DNA, 661 bp, Homo sapiens
  Payload ID: 4786
  Gene Symbol: DEPDC1B
  Gene Name: DEP domain containing 1B
  ENST ID: ENST00000512452
  CDS Start-End: 98-208
agcgcccgcagcccgcgggcttgggattcaaactgctgctcctccggctggcggggatcagcgctggcgcggctgcggccgctgctgcctacgcgccatggagcatcgcatcgtggggcccgggccgtaccgagctaccaggctgtttctatttttgaggccgggtgcagtggctcactcctgtaattccagcactttgggaggctgaggcggctggatcacttgagatcaagagttcgagaccaccctgaccaacatgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatg

SEQ ID NO: 126410 - DNA, 1596 bp, Homo sapiens
  Payload ID: 4786
  Gene Symbol: DEPDC1B
  Gene Name: DEP domain containing 1B
  ENST ID: ENST00000512078
  CDS Start-End: 42-110
atcagcgctggcgcggctgcggccgctgctgcctacgcgccatggagcatcgcatcgtggggcccgggccgtaccgagctaccaggctgggattgattctgttatcctgaagtggtccagtgtttcttatacttgaagattaggatcattgtgtgtggaatgagaccgtggagctttttcgtgctaagatgccgttacggaaacatcgctgtcgtttcaagagctatgagcattgtttcacagcggccgaagctgtggattggctgcatgagctgctgaggtgcagtcaaaacttcggccctgaagtgacccgcaaacaaacggtccagctgctaaaaaaattcctgaagaatcacgttattgaagacatcaagggaaaatggggtgaggaagattttgaagacaatcgtcacttatacagatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaa

SEQ ID NO: 126411 - DNA, 768 bp, Homo sapiens
  Payload ID: 4787
  Gene Symbol: DEPDC4
  Gene Name: DEP domain containing 4
  Uniprot ID: Q8N2C3
  ENST ID: ENST00000299185
  CDS Start-End: 4-177
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaatcgataactggcttaatgcagcaattgaatgcttggagtatttccctgaccagttaatagttacagttagtcagcagttaatgcaaaacagaaatgaagagacaagattgaacagtcagaagaagatactctttgatgtcatagcaaaatactatgctcaagagagagattgcctattaactgatgagtattttgatattcattcaggaattattgaacttttagaaaatgagaaaagagcagaagcacttgaagcaacacaactatatctaagattgctgt

SEQ ID NO: 126412 - DNA, 2337 bp, Homo sapiens
  Payload ID: 4787
  Gene Symbol: DEPDC4
  Gene Name: DEP domain containing 4
  Uniprot ID: Q8N2C3
  ENST ID: ENST00000378244
  CDS Start-End: 4-888
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaattacgacggctacttacttttatggcaatggcatcagagcccaatgcctacaagttgcaaaaacagtatgataataaaacagtggtcctgaaaactcttgccaaatcagttttgcaagccaaatcattattaaaagtgcgggcagaacaactggtctggtttccactggagtaccactctgagctcttcaaggtatggctgaaaataacagctacacatctacagcttaggatactggagatttaatgagaaaaagtaccaaaaggttgacacatggctttacgttttgccaacccttgacatacaaggagtttgaaaagcagaagggaaggacaattcagtatctacaccagttggctcttgagattaatagtaaccccagcatctctctgaaacgaaaaaagaaattaattaaggaatttcaaaaacaccatccagaagctttgaattaacatttctgatacaagaaactacaatttttggggaggaagttagtatacttccagtggaagacctgagagggtacctgaagagataccgggaaaatattggaaacatgccaccaagccctcttcgatagaagtctccttatttggaaagttgccattttaatgttcagtgtgaatcagagacggggtcaaacactgttgcccaggctggagtgcagtgacgcaatcctaactgactgtaacctcaaactcctggactcaagccatctccctaccttggccacccaaagtggtagaattacagaggaaggctgaggcaggaggattgcttaaacgcaggagtctgcagctgcaatgaactgtgatcccactactgcattccagcctgggtggacagaacaaggccctgtctctattttaaaataataataacacaaaaatgcccctcccccatttttttttaaagttcagtatgtaacaagttctatactggatcctttctttctctaataatcctcaagaaatccttacaggtaagtattgcttccgccactgcagaggcgaaagccagtgctttggtaaaggtcctagtctttctggctttaacacagaaagtcttaataccatttggattaaagattcacaagttaggccgggcgcggtggctcatgcctgtaatcccagcactttgggaggccgagacaggcagatcacgaggtcaggagatcgagaccatcctggctaacacggtgaaaccctgtctctactaaaaatacaaaaaactagccagcctggtggcgggcgcctgtagtcccagctacttggaaggctgaggcaggagaatggcgtgaacccgggaggcagagcttgcagtgagccaagatcacgccactgcattccagcctggacgacagagcgagactccgtctc

SEQ ID NO: 126413 - DNA, 1155 bp, Homo sapiens
  Payload ID: 4787
  Gene Symbol: DEPDC4
  Gene Name: DEP domain containing 4
  Uniprot ID: Q8N2C3
  ENST ID: ENST00000416321
  CDS Start-End: 4-888
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaattacgacggctacttacttttatggcaatggcatcagagcccaatgcctacaagttgcaaaaacaggtgaaaaattttgcaataagttttgccatttttttttgctatttttttcctctaaaaaccatttatgctaatgttaatctttctgtttacagtatgataataaaacagtggtcctgaaaactcttgccaaa

SEQ ID NO: 126414 - DNA, 541 bp, Homo sapiens
  Payload ID: 4787
  Gene Symbol: DEPDC4
  Gene Name: DEP domain containing 4
  Uniprot ID: Q8N2C3
  ENST ID: ENST00000549341
  CDS Start-End: 4-177
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgt

SEQ ID NO: 126415 - DNA, 1003 bp, Homo sapiens
  Payload ID: 4787
  Gene Symbol: DEPDC4
  Gene Name: DEP domain containing 4
  ENST ID: ENST00000549249
  CDS Start-End: 4-1003
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaaggagtttccttctacacagcaattacatcagataagacagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaatcgataactggcttaatgcagcaattgaatgcttggagtatttccctgaccagttaatagttacagttagtcagcagttaatgcaaaacagaaatgaagagacaagattgaacagtcagaagaagatactctttgatgtcatagcaaaatactatgctcaagagagagattgcctattaactgatgagtattttgatattcattcaggaattattgaacttttagaaaatgagaaaagagcagaagcacttgaagcaacacaactatatctaagattgctgt

SEQ ID NO: 126416 - DNA, 1165 bp, Homo sapiens
  Payload ID: 4787
  Gene Symbol: DEPDC4
  Gene Name: DEP domain containing 4
  ENST ID: ENST00000550587
  CDS Start-End: 4-1165
gctatggtgccaggggaggagccagcgcgcgagcttatggcggttcttttgactccgaggttccgtagacttgtcagtcagaacgagcttccgggcccagggctgaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaatcgataactggcttaatgcagcaattgaatgcttggagtatttccctgaccagttaatagttacagttagtcagcagttaatgcaaaacagaaatgaagagacaagattgaacagtcagaagaagatactctttgatgtcatagcaaaatactatgctcaagagagagattgcctattaactgatgagtattttgatattcattcaggaattattgaacttttagaaaatgagaaaagagcagaagcacttgaagcaacacaactatatctaagattgctgt

SEQ ID NO: 126417 - DNA, 389 bp, Homo sapiens
  Payload ID: 4787
  Gene Symbol: DEPDC4
  Gene Name: DEP domain containing 4
  ENST ID: ENST00000548313
  CDS Start-End: 1-317
gaattgaggaacttattcatacaataaatgggaatccagctttatgtccaaatatcacagttcagaaaccttttctccggctttcaaaagaaggagtttccttctacacagcaattacatcagataagacagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaatt

SEQ ID NO: 126418 - DNA, 1033 bp, Homo sapiens
  Payload ID: 4787
  Gene Symbol: DEPDC4
  Gene Name: DEP domain containing 4
  ENST ID: ENST00000551642
  CDS Start-End: 1-861
gcgcgcgagcttatggcggttcttttgactccgaggttccgtagacttgtcagtcagaacgagcttccgggcccagggctgaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgagtaagtgaccatttttattgtcaaataatttgtaaacagtttttttcacatatttgcccttagtattttaggatgtgagaaaatattcatgttataagcttatactatctctcttttataaattatcattatgaatcctcatttgatctaataaagccattggtcatgacctataa

SEQ ID NO: 126419 - DNA, 5212 bp, Homo sapiens
  Payload ID: 4788
  Gene Symbol: DEPDC5
  Gene Name: DEP domain containing 5
  Uniprot ID: O75140
  ENST ID: ENST00000382111
  CDS Start-End: 61-4719
ggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggacggggccttctttatggagtttgtccgcagcccacgcacagcatcgtccgccttctaccctcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccactt

SEQ ID NO: 126420 - DNA, 5363 bp, Homo sapiens
  Payload ID: 4788
  Gene Symbol: DEPDC5
  Gene Name: DEP domain containing 5
  Uniprot ID: O75140
  ENST ID: ENST00000382112
  CDS Start-End: 71-4855
tctgtggcagggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggacggggccttctttatggagtttgtccgcagcccacgcacagcatcgtccgccttctaccctcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctcc

SEQ ID NO: 126421 - DNA, 2395 bp, Homo sapiens
  Payload ID: 4788
  Gene Symbol: DEPDC5
  Gene Name: DEP domain containing 5
  Uniprot ID: O75140
  ENST ID: ENST00000400242
  CDS Start-End: 157-1836
ggcgtaggcggggtatctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagagcacctaggataaagtgcagtgatgcaatcacagctcacctcagtgcggccttgaactcctggactcaatcgatcctcccacctctgcctcccaagtaactgggactatagcatgccaccacacccagctgattatcatatttttttttgtagaggtggggaagtgcagtgatgcaatcacagctcacctcagtgcggccttgaactcctggactcaattgatcctcccacttctgcctcccaagtaactgggactatagcatgccaccacacccagctgattatcatatttttttttgtagaggtggggttttaccattcccaggctggtcttgaactcctggactcgagggatccacccattggcctccaaaagtgctgagattacaggcatgaaccaatgttaccgcaccctgcctctattatactattttttgtttagcctttcttcatccatcatttaactgtatgcctttccatatgttaatggaaagcttttcttaggcctagggtcaaaagggtttatttccttatgatttccatttgtgccatatataaaacaacctctgtct

SEQ ID NO: 126422 - DNA, 5551 bp, Homo sapiens
  Payload ID: 4788
  Gene Symbol: DEPDC5
  Gene Name: DEP domain containing 5
  Uniprot ID: O75140
  ENST ID: ENST00000400246
  CDS Start-End: 203-5014
ctagtaggcgcttcaggcttaggggcggaacagcgcgggccgcgcgggcgtaggcggggtatctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggacggggccttctttatggagtttgtccgcagcccacgcacagcatcgtccgccttctaccctcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatcatttctttccccacccagtt

SEQ ID NO: 126423 - DNA, 5307 bp, Homo sapiens
  Payload ID: 4788
  Gene Symbol: DEPDC5
  Gene Name: DEP domain containing 5
  Uniprot ID: O75140
  ENST ID: ENST00000400248
  CDS Start-End: 60-4778
gaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatcatttctttcccc

SEQ ID NO: 126424 - DNA, 5458 bp, Homo sapiens
  Payload ID: 4788
  Gene Symbol: DEPDC5
  Gene Name: DEP domain containing 5
  Uniprot ID: O75140
  ENST ID: ENST00000400249
  CDS Start-End: 203-4921
ctagtaggcgcttcaggcttaggggcggaacagcgcgggccgcgcgggcgtaggcggggtatctggaggaggcgcagggaacctggagagggtccagccctcagtgccccggccagaggcgggaaggggctctagagcttcgggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaatgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatcatttctttccccacccagtt

SEQ ID NO: 126425 - DNA, 3260 bp, Homo sapiens
  Payload ID: 4788
  Gene Symbol: DEPDC5
  Gene Name: DEP domain containing 5
  ENST ID: ENST00000448753
  CDS Start-End: 1-1980
gcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggacggggccttctttatggagtttgtccgcagcccacgcacagcatcgtccgccttctaccctcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaa

SEQ ID NO: 126426 - DNA, 549 bp, Homo sapiens
  Payload ID: 4788
  Gene Symbol: DEPDC5
  Gene Name: DEP domain containing 5
  ENST ID: ENST00000456178
  CDS Start-End: 79-159
agcggcgcgggttctcagggaggcaagatgacttctctgccccaagcttggaacagctaaagggaaaaacagtgcaagatgagaacaacaaaggtctacaaactcgtcatccacaagaagggctttgggggcagtgtggctgaattgtctttcagatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggt

SEQ ID NO: 126427 - DNA, 3450 bp, Homo sapiens
  Payload ID: 4788
  Gene Symbol: DEPDC5
  Gene Name: DEP domain containing 5
  ENST ID: ENST00000433147
  CDS Start-End: 1-2938
ctctcggatgcccatgaagcttacgtccaacagaaggcgctggatgcacacttttcctgtggggccatccggagaagccatccagatccaccaccagacccgacagaatatggcggagctacaaggcagcgggcagagggatccaactcactcctctgcagagctgctggagttagcatatcatgaagctgctggaaggcacagcaattcccgccagcctggtgacggcatgtccttcttgaacttcagtggaacagaggagctttctgtcggcctgcttagcaacagtggtgcaggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgt

SEQ ID NO: 126428 - DNA, 434 bp, Homo sapiens
  Payload ID: 4788
  Gene Symbol: DEPDC5
  Gene Name: DEP domain containing 5
  ENST ID: ENST00000458532
  CDS Start-End: 1-181
tgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggtactgtgtctatgtgctgattgtaactgctaaggggagaattttctggaactgcaaatgctaattcatgaatgcccagggtcccccacatcatcttctaacaaactttaaatatcattgtgagaataatcatatttggaggttagagtgttttctcgttctaaagatacactacttttttcaataatcaaatttttttcaaactgcattgtatgttgaagtcatagcctcttagtagtgaggcagatattaaatttggcttcaaaaaataaa

SEQ ID NO: 126429 - DNA, 236 bp, Homo sapiens
  Payload ID: 4788
  Gene Symbol: DEPDC5
  Gene Name: DEP domain containing 5
  ENST ID: ENST00000437411
  CDS Start-End: 100-236
gccccggggcggagccaccggagcggcgcgggttctcagggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacga

SEQ ID NO: 126430 - DNA, 5155 bp, Homo sapiens
  Payload ID: 4788
  Gene Symbol: DEPDC5
  Gene Name: DEP domain containing 5
  Uniprot ID: O75140
  ENST ID: ENST00000535622
  CDS Start-End: 107-4618
aggcggggccccggggcggagccaccggagcggcgcgggttctcagggaggcaagatgacttctctgccccaagcttggaacagctaaagggaaaaacagtgcaagatgagaacaacaaaggtctacaaactcgtcatccacaagaagggctttgggggcagtgatgatgagctagttgtgaaccccaaagtgttccctcacatcaagcttggagacattgtagagattgcacaccccaacgatgaatacagccctctgcttttgcaggtcaagtctcttaaggaagatttacagaaggaaactatcagtgtggaccagactgtgactcaagtgttccggctgagaccttatcaggatgtctatgttaatgtcgtagaccctaaggatgtgacccttgacctagtggaattaacttttaaggatcagtatattggccgtggggatatgtggcgactaaagaaaagtttggtcagcacatgtgcctatatcacccagaaggtggagtttgctggcatcagagcacaggctggtgaactgtgggttaagaatgagaaggtcatgtgtggctacatcagtgaagataccagggtggtgtttcgttctacgtcggctatggtttacatatttattcagatgagctgtgaaatgtgggattttgatatttatggggatttgtattttgagaaagctgtgaatggtttccttgctgatctatttaccaagtggaaggagaagaactgtagtcatgaagtgacagtggtcctgttttctagaactttctatgatgcaaaatctgttgatgaatttcctgaaataaaccgagcctcaattcgacaggatcacaaggggagattctatgaagacttttacaaagtggtggtgcagaatgagagaagagaagaatggacttcacttctcgtaaccattaaaaaactcttcatccagtatccagtgttggtgcgactggaacaggcagagggctttcctcaaggagataattctacctcagcacaaggaaactacctggaggccatcaatctgtcattcaatgtgtttgataagcactacatcaaccgcaactttgaccgaactgggcagatgtcagtggtgatcacgcccggggtgggtgtctttgaagtggaccgcctactcatgatcctgaccaagcagcggatgatagataatggaattggtgtggatttggtgtgcatgggagagcaaccgttacatgctgtcccattgttcaagctccataatcggagtgctccccgtgattctcgtctgggcgatgactataatatccctcactggataaaccacagtttctacacatccaaaagccagctcttttgtaatagtttcaccccacgaataaaactggcaggaaagaagcccgcctctgagaaagcaaaaaatggccgtgatacatctctcgggagtccaaaagaatctgagaacgcccttcccatccaagtagattatgacgcctatgacgctcaagtgttcaggctgcccggcccatcccgggcccagtgcctcaccacctgcagatctgtgcgagagcgagagagtcacagtcgaaagagtgccagctcctgtgatgtttcatccagcccttccctaccaagccgcacactgcccactgaggaagtgaggagccaggcttctgacgacagctccctaggcaagagtgccaacatcctgatgatcccacacccccacctgcaccagtatgaagtcagcagctccttgggatacaccagcactcgagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtatgaatcctaggacccagaataaggattctctagaggacagtgtttctacctctccagacccaattctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggagggacgaagatggtgtgcagatgacagcccagcaggtatttgaagagtttatttgccaacgtctcatgcagggctaccaaatcatagtgcagcccaagacacagaaacccaatcctgctgtcccgcccccgctgagcagtagcccactctatagccgaggccttgtgtcccgaaaccgccctgaggaggaggaccagtattggctgagtatgggcagaacgttccacaaagtgacgctgaaggataagatgatcacagtgacgcgataccttcccaagtatccttatgaatctgcccagatccactacacctacagcctctgtccttcccactcagactcagagttcgtctcctgctgggtggaattctcccacgaacggctggaggagtacaagtggaattacttagatcagtatatctgttctgccggctctgaagacttcagcttaattgagtccctgaagttctggaggacccgcttcctgctgctgccagcctgtgtcaccgccaccaagcgcatcacggagggggaggcccactgcgacatctatggggacaggccccgtgcagacgaggacgagtggcaactcctggatggttttgtccgctttgtggagggcttgaatcgcattcgcaggcggcatcgctcggatcgcatgatgcggaaagggaccgccatgaaaggcttgcagatgactgggcccatttccacgcattctctggagtcaactgcacccccagtggggaagaagggaacctcagctctctctgccctgttggagatggaggccagtcagaagtgcctgggagaacagcaggcagctgtgcatggtgggaagagctccgcccagtcagccgagagcagcagcgttgccatgactcccacctacatggacagcccacgaaaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcagctctcagcagctggtggcaagctccttgacctcatcctctaccctgacagagatcctggaagccatgaagcacccctcgacaggagtccagctgctctctgaacagaagggcctctcaccgtactgcttcatcagcgcggaggtggtacactggttggtgaaccacgtggaggggatccagacacaggcgatggccattgacatcatgcagaaaatgctggaagagcagctcatcacacatgcatctggcgaagcctggcggaccttcatctacggcttctatttctacaagatagtaacggacaaagagcccgaccgagtggccatgcagcagcccgccaccacctggcacacagcaggagtggacgacttcgccagcttccagcgcaagtggtttgaggtggcctttgtggcagaagagctcgtgcactctgagattcctgcctttctcctgccctggctgcctagccggccagcctcctatgcaagtaggcacagctcctttagccgaagttttggaggacggagccaggcggcagcacttttagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtccaaggttggcatcggaaagccacctcctgtggcttcttgttagtcccagttttggaggggccttttgcactgcccagttacctgtatggcgacccccttcgtgcccagctcttcatcccactcaacatcagctgcttgctcaaggagggcagcgagcacctgtttgatagctttgaacccgaaacgtactgggatcgaatgcacctcttccaggaagccattgcacacaggtttgggtttgtacaagataaatattctgcctctgcttttaacttccctgctgagaacaagcctcagtatatccacgttacaggaacagtgtttctgcagctgccctactccaagcgcaagttctcagggcagcagcggcggcggcggaactccaccagctccaccaaccagaacatgttctgcgaggagcgggtcggctacaactgggcctacaacaccatgctcaccaaaacatggcgctccagcgccacaggggatgaaaagtttgctgatcggctgctgaaggacttcacggacttctgcatcaaccgtgacaaccggctggtcacgttctggacaagttgcctggagaagatgcatgccagtgccccgtgaggccaggctgcacctgtgctgggggaaggtgggtgagccactgccctcaaacccggggcggaggattccaggcaggctctaggagtcaggtgtccgtttgctgctatcagtgagtgggggccattgttttttgtttgtttgtttgtttgtttgtttgtttttggcccccacgacaagtcttctactctagaagaaagactttggaagcagctgctgctgctgccaccactcctgtcagcaagtgctcagagcaggtgggaggcacagattgtccgtgggagggctccagtgtctgggaagagggcaggcggcccccatgaatgtcctcggaagggggtggctcctggtagcatccttttccttcaccatctatgggatattaggggcagaatctgccacttcttgcccaggagtgtgcacagatgtaagataattttgtgaaataatgtaccatagactctcaccaactgtatatacctgtacatatcagaagcaaataaagagctccacgtgcatcatttctttccccacccagtt

SEQ ID NO: 126431 - DNA, 1755 bp, Homo sapiens
  Payload ID: 4789
  Gene Symbol: DEPDC7
  Gene Name: DEP domain containing 7
  Uniprot ID: Q96QD5
  ENST ID: ENST00000241051
  CDS Start-End: 93-1628
gagccacgccccgcacagttaacagacgggcgctcagggagctagggagctgtgaagctgctggaggagttggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataa

SEQ ID NO: 126432 - DNA, 2012 bp, Homo sapiens
  Payload ID: 4789
  Gene Symbol: DEPDC7
  Gene Name: DEP domain containing 7
  Uniprot ID: Q96QD5
  ENST ID: ENST00000311388
  CDS Start-End: 377-1885
agctgcgaccacttggccaacgcccccgccgagcgggcggatcgagttcctctctggctggtgggctgcaagcggcagagcccgcccgcacagcccagcttttttctttctacccagactctcaacttgaccgcgcgttggtctgtgcgcccgctaacgtgccaggcacgcgccggggagctccgggatatgctccgcggtgctaccggtgacaagtgtggtatctggaatttgtgtagttctttgccccctgtctcaaccacaaaccttgacgacacagtatggccaggggccgagctcctcccttgcccactttgttctccagactgctaggagtcaagagtcagcttgtctccccagactcttcctgggagggatgagaggtttatgtgagttctactggcaggaatttggcataaaaggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgtataa

SEQ ID NO: 126433 - DNA, 1988 bp, Homo sapiens
  Payload ID: 4789
  Gene Symbol: DEPDC7
  Gene Name: DEP domain containing 7
  ENST ID: ENST00000616885
  CDS Start-End: 264-1865
aacgcccccgccgagcgggcggatcgagttcctctctggctggtgggctgcaagcggcagagcccgcccgcacagcccagcttttttctttctacccagactctcaacttgaccgcgcgttggtctgtgcgcccgctaacgtgccaggcacgcgccggggagctccgggatatgctccgcggtgctaccggtgacaagtgtggtatctggaatttgtgtagttctttgccccctgtctcaaccacaaaccttgacgacacagtatggccaggggccgatcctcccttgcccactttgttctccagactgctaggagtcaagagtcagcttgtctccccagactcttcctgggagggatgagaggtttatgtgagttctactggcaggaatttggcataaaaggtttcagtgtagctcagaagccatttggagccacgtatgtatggagcagcatcataaacactcttcaaacacaagtggaagtgaaaaaacgaaggcaccgtttaaaacgacataatgactgctttgttggttcagaagctgtggatgtcattttttctcacctaattcagaataagtattttggtgatgtagatattcctcgagccaaagtggtgagagtgtgtcaagcgcttatggactacaaagtatttgaagcagttccaaccaaagtctttggaaaagacaaaaaacctacatttgaagatagtagttgcagcctttatagattcaccacaatacctaaccaagacagtcagttaggcaaagagaacaaactatattcacctgccaggtatgcagatgcattatttaagtcatccgatatcagatcagccagtttagaggacctgtgggaaaatctgagtttaaagcctgccaactcccctcatgtaaatatctctgcaaccttgtctccacaagttattaatgaagtgtggcaagaagaaacaattgggcgtctactacaacttgtagaccttccacttcttgactccttactgaaacagcaagaggctgtacctaaaattcctcaacctaagaggcagtccaccatggtcaacagcagtaactatctggatcgagggattctcaaggcttatagtgactctcaggaagatgagtggctctcggcagcaattgactgtttagaataccttccagaccaaatggtggtggaaataagcagaagctttcctgagcaaccagaccgaacagacttagtgaaagaacttctgtttgatgccattggcagatattacagtagtagggaacctctgttaaatcacttatctgacgttcataatggaattgcagaactcttagtgaatgggaagacggaaatagctttagaagctacccagctccttctaaagcttttagatttccaaaatagagaagaatttagaagactactgtatttcatggctgttgcagcaaatccttctgagtttaaattacagaaagaaagtgacaaccgaatggttgtgaaaaggatattctcaaaagctattgttgacaataaaaatttatccaaaggcaaaacagatcttctggtactctttttaatggatcatcagaaagatgtttttaagattcctggaactctacataaaattgtaagtgttaagcttatggccatacagaacggaagagatccaaatagagatgcaggatatatttattgccagagaattgatcaacgtgactattccaacaatacagagaagacaaccaaagatgagctgttgaatttactaaaaactcttgatgaggattcaaaactttctgccaaagagaagaaaaaattgctaggtcaattctataagtgtcacccagacatctttattgagcattttggagactgagtttttaatatctgtatataagttgtgtattttaagaataaattatgtatcctaaatatccaatcacatttgtaagcgtggaagctctaaatttgaaactgtacttaataaaaatttttttgt

SEQ ID NO: 126434 - DNA, 2569 bp, Homo sapiens
  Payload ID: 4790
  Gene Symbol: DEPTOR
  Gene Name: DEP domain containing MTOR-interacting protein
  Uniprot ID: Q8TB45
  ENST ID: ENST00000286234
  CDS Start-End: 131-1360
aatccagtcagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaagatttcactttgaaggtgtctgtttttaagggaaggctaaaactttgctgatatgtgataaaacttgaactctaaattgcctccttagcctgaatttttactagctttctagtgtaacatattctaaggacatgacatgctgcttatttggggggattatttttcaccaaaatgatcatcttgtgttgtaacttttcagctcacttgtatatacgcacgttttcatttttggtctagaaaatagtgcattttggggctcagcgtgcagaggaaattcctcaaagtgccaaattaggcagtcaggaaatactaaattcttcattccaaataatggatctgaatgatgacgttaattttttatcatgcattaacaaaataaaatatgagaattgta

SEQ ID NO: 126435 - DNA, 1397 bp, Homo sapiens
  Payload ID: 4790
  Gene Symbol: DEPTOR
  Gene Name: DEP domain containing MTOR-interacting protein
  Uniprot ID: Q8TB45
  ENST ID: ENST00000523492
  CDS Start-End: 131-1057
aatccagtcagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccaacaagcacccatttgtggacagcaatcttctctaccagttcagaatgaacttccggcggaggcgaagactgatggagctgctcaatgaaaagtccccctcctcccaggaaactcatgacagtcccttctgcctgaggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgct

SEQ ID NO: 126436 - DNA, 2122 bp, Homo sapiens
  Payload ID: 4791
  Gene Symbol: DCAKD
  Gene Name: dephospho-CoA kinase domain containing
  Uniprot ID: Q8WVC6
  ENST ID: ENST00000310604
  CDS Start-End: 340-1035
attcggccacgctttgaggaaagaaggggcgcaaggttggtgggaccgacccttgggaaccgggcggccgcctggcatgatgggagttgtagttcgatgctggtttagggtttcaggcgtggaggttccaaaatccgaggtttgatttcagcctgcccttgccagtgcctgggccgctgggagccgttattggctgccgttaaggaccgttacgtttcccggcaggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagacc

SEQ ID NO: 126437 - DNA, 2030 bp, Homo sapiens
  Payload ID: 4791
  Gene Symbol: DCAKD
  Gene Name: dephospho-CoA kinase domain containing
  Uniprot ID: Q8WVC6
  ENST ID: ENST00000342350
  CDS Start-End: 246-941
gttcgatgctggtttagggtttcaggcgtggaggttccaaaatccgaggtttgatttcagcctgcccttgccagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaa

SEQ ID NO: 126438 - DNA, 2045 bp, Homo sapiens
  Payload ID: 4791
  Gene Symbol: DCAKD
  Gene Name: dephospho-CoA kinase domain containing
  Uniprot ID: Q8WVC6
  ENST ID: ENST00000452796
  CDS Start-End: 257-952
ctcctctccagatggccccagagcaccccaagctcaggacatgtccctccccagccaagctgtctccctttacttcctttgcctcctctctcccaattattttggcccaaactgatcagtcccgctggcctctcccaagcaggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaaccaa

SEQ ID NO: 126439 - DNA, 990 bp, Homo sapiens
  Payload ID: 4791
  Gene Symbol: DCAKD
  Gene Name: dephospho-CoA kinase domain containing
  Uniprot ID: Q8WVC6
  ENST ID: ENST00000588499
  CDS Start-End: 173-868
gtaagcgctgcggagattgggctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacac

SEQ ID NO: 126440 - DNA, 1000 bp, Homo sapiens
  Payload ID: 4791
  Gene Symbol: DCAKD
  Gene Name: dephospho-CoA kinase domain containing
  ENST ID: ENST00000593094
  CDS Start-End: 374-1000
agccggcctgtaagcgctgcggagattgggctagaggcggaggcctgggccacggcggaggcgctgggtacgtagcgcgccacgcgggccggtgagagccagccgggcgccggggagggggcgggccctggccgcggctgctacgcggggctgccaccgccccgggcgacccaatttcgcggcctagtggggcgtacgggcctcttttgaaagcctgagttacgatgtattgagcgcgtcgtatgcggccagcactaaggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtc

SEQ ID NO: 126441 - DNA, 2054 bp, Homo sapiens
  Payload ID: 4791
  Gene Symbol: DCAKD
  Gene Name: dephospho-CoA kinase domain containing
  Uniprot ID: Q8WVC6
  ENST ID: ENST00000614054
  CDS Start-End: 272-967
ccgggcgccggggagggggcgggccctggccgcggctgctacgcggggctgccaccgccccgggcgacccaatttcgcggcctagtggggcgtacgggcctcttttgaaagcctgagttacgatgtattgagcgcgtcgtatgcggccagcactaaggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaacggcgacataaatcgcaaggtcctgggggacctgatctttaaccagcctgaccggcggcagctgctcaacgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccccacacacacacacacacacacacacacacacacacacacacacacacacacacggactctccgaatcagggctgggcctctgtgccaggccatcccgtctttggagtgtatcctatttgagatcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattgtggcctaaacctcctcagtggaccacgggaaatcatgttggaccaagggtttccatgttcaaacagtcaacaaggccctcccctaggttgagatattttttatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttcctttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagacc

SEQ ID NO: 126442 - DNA, 3340 bp, Homo sapiens
  Payload ID: 4792
  Gene Symbol: DERL1
  Gene Name: derlin 1
  Uniprot ID: Q9BUN8
  ENST ID: ENST00000259512
  CDS Start-End: 302-1057
acctggctccgccccccaggacgccgagcctcggccgggcggtaaaatcggcgcttaccctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctggatgcagaattcctgggttttcattttaatgaaggaggatgcttgctaactttga

SEQ ID NO: 126443 - DNA, 1994 bp, Homo sapiens
  Payload ID: 4792
  Gene Symbol: DERL1
  Gene Name: derlin 1
  Uniprot ID: Q9BUN8
  ENST ID: ENST00000405944
  CDS Start-End: 1-696
atgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggcc

SEQ ID NO: 126444 - DNA, 918 bp, Homo sapiens
  Payload ID: 4792
  Gene Symbol: DERL1
  Gene Name: derlin 1
  ENST ID: ENST00000419562
  CDS Start-End: 181-636
agaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctg

SEQ ID NO: 126445 - DNA, 542 bp, Homo sapiens
  Payload ID: 4792
  Gene Symbol: DERL1
  Gene Name: derlin 1
  ENST ID: ENST00000523036
  CDS Start-End: 86-541
attctcccttccagatgcagtatgaggactgagtcagaggctatggaaaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaa

SEQ ID NO: 126446 - DNA, 575 bp, Homo sapiens
  Payload ID: 4792
  Gene Symbol: DERL1
  Gene Name: derlin 1
  ENST ID: ENST00000519018
  CDS Start-End: 115-570
agagactttctttttcagtatctaaggccagtgtggtacaggtggttgtgtgtgtgtatgtgtgtttctaataataatggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaagggg

SEQ ID NO: 126447 - DNA, 4209 bp, Homo sapiens
  Payload ID: 4793
  Gene Symbol: DERL2
  Gene Name: derlin 2
  Uniprot ID: Q9GZP9
  ENST ID: ENST00000158771
  CDS Start-End: 57-776
gctggcggaaggggaaatggggtgggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgtattaaagcttttgtgtgtgatcttttaaattctgataatgtattgtagccctcctgcgtagatctgagctcagaacagtttacacagctgttcttcctgtgtcttcacaacttttaactggatttcatttcaggattggaaatacgtggctgtcatgctgtggttgtgtacatcttactaactcagaatgcaagattcagcaggaagatgatttatttctgtcatctggataggttgttttgcatctgggttttgccaaactttgtcagacaacatgaaaaaaaaggagggaggatggttcttgtagcagtaggaattcagctataggaaagtcagctgtaagctaatgtggcatcttatttgctttacttacatttctccattaagaagtatccagggaaagattggtaagggccacatttttgtaaaactaggaagattttcattagactttttttttcttttatttttaaaaaagttttaattaaaaatttttttttaaatacagatggggtctcactgtgttgcccaggctggtcttgaactcctggactcaagcaatcctcccacctcagcctcccaaagtgctaggatgacaggcatgagccaccatgcccagccattttttttttttttgccttttttgttttgttttgttttttgtttttttaattaaaaaaaaaaaatagagacagggtctcagattttcattagatttggaaaccaagttagaatgttgactttggagccagacgaacagataccagttagctaggcatatgttcttccagggtctttggctagttaacattagtcatttgcttcgtgaaaattcaagaaccttttcagagccaagtacctggattaccttcccaatcaggtagaaattagacagggtccacagaagtagacacttaatgctgtggttcaataaatacttcccctaaatattaagtcttccctgagtctcagcaggtttgcattcacactgcttaagtaacttccagaacctggaagagtcgaaagagcacccctaggaaagagatgattccaaacagctttcattaacggcatgtaggcacaggtccctttcccaaaagtggattgttagtagtagttcattcaacctttgttaaggggtagctttccagaatgtgacattgtcctcagaaagatagacataggcttaaacataatggacatcctaaataggaattttcagattgtttttgaagtgaaaagtgttttaatgtctttaaatggaattgcataactaatggtatttaagtattttacatgttgctaataactttgaatatgattgttgcaattttatggaacctgggtctatgggactgctttttaagcagtttaaaaaaggttttcaaagtttaaaagccaatcttagcatgtataatccttatgggattcttaagttttatcctatcttgtttttgctcaagaacgctttatcagtgacgtttgttagaattttgttttttgttttttttttttaaattgtttttgggctagaaatgagtttctctagttttatttgttctccctgagttggagttatgcaatgaatggcatttttgtggtaaaatactaatcctaaaatctgttaactcactgttcatttaagtagggaatatctgtatacattaatgactaggtaaaacaggaaatacattttgaatatacagcctaaaggcaggcagttacagggtttttgatttctccgattttatagggtgcaagttcccagtggcaggatgccctgctgtgtgactgactacactgtgtcctgagcagtggtaatttcaatcacctctcatcagtttggccagccctacaaccaccattcctagccctgtgttgcttgacaggatacctgtgcttgaatggacataaggaaaagtccttactttctccccaatttacctctcaatcttagttcttccagaacacacttccctttcacaatgcaaataaactgaaagtgagatttgatacatggaattttgagaccaaccaactaaccttacacataatttgagggattcctggattcttctagtgatactgaaaagcacacttgactaaagcatagtgttttttgtttgttatggaaatacggtatacgttcatttaaaaataaatggacatacaaattgcatctccttaggagatacattttatatacatttcggtgcgtttttttccagtatggatttctatttgtttctctcttcctcttgttttttctgtgtcactcttgtatgtcctcatatctttcatacctcttgtgtagtctctagaagcagaacacctaagtcctgggtctggataatgaaaccctcagtctctggggcctctgaaaataaggaagcattggagctattgccatgttgagtaatgggcttcctagaactattgtcatctatcctgccagtgttttatgttgtagctgtttttctttgacaggtgagttccagctatgttgttagtcatgatcctgccattattttctgtgttctgtaggatgtctccaggctacttaaacatattttatgagtttgcaataaaattgttgaatcttgtatgatcaagtcactcctctgctcagaaatccacagtgacttcttagtaagcccctacattatatgcatacttgtttttttcttaactttactcccacttctacctaacagggacctcaacttaagtctcttcagttcttcaaggcctggccttgttcctgattcctcaaaaaatcttgactctaaggcctattttattgtctgtctctgaatccctataaagcttcaagtctgtatgacattcttaacgccaaattatatattgtcttgtactgttcctagctggtacatgtatattagtcttgtctccctcatgagaatgtaagctccttaagggcagggaccatgtcttaatttttgtatccaccacagtgcctagcacagtgcttggcacatgggtgctgaataaatacctttgtttattgatcagcaaagta

SEQ ID NO: 126448 - DNA, 617 bp, Homo sapiens
  Payload ID: 4793
  Gene Symbol: DERL2
  Gene Name: derlin 2
  ENST ID: ENST00000571971
  CDS Start-End: 18-617
aggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgacccagtcggacaggatgagcaagtcaaaggaacttttaacccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctg

SEQ ID NO: 126449 - DNA, 876 bp, Homo sapiens
  Payload ID: 4793
  Gene Symbol: DERL2
  Gene Name: derlin 2
  ENST ID: ENST00000573637
  CDS Start-End: 5-316
gaagatggcgtaccagagcttgcggctggagtacctgcagatcccaccggtcagccgcgcctacaccactgcctgcgtcctcaccaccgccgccgtggtgagcagctgcagtgccaccttctcattatctgggctggatatgactgggtcttcaggaaactggggtttgggcctcggggaggcccagaggggctggtcccggggatgggtggaggcgtacagggattactctggggttcgagttggcgccaagaatgcttatccagtgacgcgagaagggagtgctgcttcatggggggtcagcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccgtatccttcaacaaacaacacgggaaaatgttgaagaacaccctggctcttcctaaagcttgtcatctgtctcccacagttctctagatcttagcttcagggcactatcatttattttacagcacattttctgtgacaagtttccaaacctagcagtcggacaggatgagcaagtcaaaggaacttttaacccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcatt

SEQ ID NO: 126450 - DNA, 657 bp, Homo sapiens
  Payload ID: 4793
  Gene Symbol: DERL2
  Gene Name: derlin 2
  ENST ID: ENST00000570848
  CDS Start-End: 18-452
aggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgacccagtcggacaggatgagcaagtcaaaggaacttttaacccaggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttg

SEQ ID NO: 126451 - DNA, 551 bp, Homo sapiens
  Payload ID: 4793
  Gene Symbol: DERL2
  Gene Name: derlin 2
  ENST ID: ENST00000575605
  CDS Start-End: 1-477
tggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgacccagtcggacaggatgagcaagtcaaaggaacttttaacccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttg

SEQ ID NO: 126452 - DNA, 501 bp, Homo sapiens
  Payload ID: 4793
  Gene Symbol: DERL2
  Gene Name: derlin 2
  ENST ID: ENST00000574952
  CDS Start-End: 116-427
agtcgcgggaaaactaaagtgggcggggggcctttgggcccgccccgccgccggggcctgctggcggaaggggaaatggggtgggtggggggtggggcaggcgacggtggggaagatggcgtaccagagcttgcggctggagtacctgcagatcccaccggtcagccgcgcctacaccactgcctgcgtcctcaccaccgccgccgtggtgagcagctgcagtgccaccttctcattatctgggctggatatgactgggtcttcaggaaactggggtttgggcctcggggaggcccagaggggctggtcccggggatgggtggaggcgtacagggattactctggggttcgagttggcgccaagaatgcttatccagtgacgcgagaagggagtgctgcttcatggggggtcagcagttggaattgatcacaccttttcagttgtacttcaatcctgaattaatctttaaacactttcaagtattgcagttggacacatat

SEQ ID NO: 126453 - DNA, 589 bp, Homo sapiens
  Payload ID: 4793
  Gene Symbol: DERL2
  Gene Name: derlin 2
  ENST ID: ENST00000572834
  CDS Start-End: 2-226
gatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaagtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactg

SEQ ID NO: 126454 - DNA, 570 bp, Homo sapiens
  Payload ID: 4793
  Gene Symbol: DERL2
  Gene Name: derlin 2
  ENST ID: ENST00000571476
  CDS Start-End: 1-239
gcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggcc

SEQ ID NO: 126455 - DNA, 624 bp, Homo sapiens
  Payload ID: 4793
  Gene Symbol: DERL2
  Gene Name: derlin 2
  ENST ID: ENST00000576551
  CDS Start-End: 1-247
ggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctcagtcggacaggatgagcaagtcaaaggaacttttaacccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctatttttcctagaatcagctgtttcttcaaggagccctggttcctttaaagtggagaatggtatttagaagccaagatctgggtgctagatgtgctcattgctattgga

SEQ ID NO: 126456 - DNA, 860 bp, Homo sapiens
  Payload ID: 4794
  Gene Symbol: DERL3
  Gene Name: derlin 3
  Uniprot ID: Q96Q80
  ENST ID: ENST00000318109
  CDS Start-End: 18-725
gtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 126457 - DNA, 3113 bp, Homo sapiens
  Payload ID: 4794
  Gene Symbol: DERL3
  Gene Name: derlin 3
  ENST ID: ENST00000404056
  CDS Start-End: 20-556
gcgtgcttgagaaggttcaatggcgtggcagggactagcggccgagttcctgcaggtgccggcggtgacgcgggcttacaccgcagcctgtgtcctcaccaccgccgcggtgttccaggtgaggccgccccgcgccgcgcacctgtgggcccgacccacccaccccgcacctgaccgcccgtcccccgtaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggctctgctggtctaggactctgggctgtggagggtgaccccacagtccgtggctgtctcacagggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgcagtctcttggcccacagcactggcttccccatctcacctggccacatccttctatgcctgccccgtcctcactcagtgtggcctctcagcccaactgcaggtggtaggataggggtgcccacagagggcaaagaaactgcccatggttgcctggcagagctttgagctcacaggttgccaggcagagcttttgagctcacaggtgacaggctcagggttctcatcctggccccaccagggccttgggcaagtcctgcccaccataggcctctgctacctgccagtcagcggggaagttcaccagatttcggctgctggggccaggacaggcgtctcctaggttgtgccaaaccagcctacagatgttcctgccagtggtgccttcaggctgatgccaatctagcctctcctgtctctcatcagccaccctgacaggtgggcgtatgcctcatttttcatctggtgatgccaaagccccatggattcaggtgcagaagagggccaggactaggtcttctgccctttctatgacctcagagcctaagttttcaccttagcagagttctgagactgggtgaggcagggacttctggaaggttctgttcctgccctttttagctgaggacgtgtgtgagccttatccgacccctgtggctcatttttctcttctgacctggcagctttccttgttgttctaagcctgtccatgttgtggtttatttctggatgctcagtggcacggggcctcctccaaagacaggttgtcattttcatggtaacaacactgttctctgttgagtctgccctccgtgttgtagccagaccttgtggagatggctttgcggcggtgtgagctggcggtcaggagtgagggcccagccttcccggcacctcccagccaggtggccctgcccgacctgtggggtgaggcagccaaggttccttccatccccccagttgtggagacacagggctgcctcaccctttcattgccgaggttcctacctcatggacagaacaaacacctcagcaatgaaacctgttcatgtctaagagcagctgggctgggaatcttcccctttgttcaaggccttccagtaaggcccagctgtccccttgctgtgcatggggctctggggagttccactctttgatggagggcagaggccctgagtgcaaactccctgggaagagtcccatgctaacatgtgctcaaaggagccctcctctcacatctcagcgaccaagaaccccaatccctaatcagagctctgcctctgccccacatggggccctaccccacttccagggagcacagcagcctctgaccctagccctgccctggcagcatgggacctgccaacagctgagggtggcagcagtctgtgctgggatctgtgcccggatctgtgcccattctcttcagtaaggctggagctgcgagccagtttgctgccctcccagatcctgtgtccattctgaagaatggggacacctccctattacagatgagaacagaggggacatgaactccttggaggcagggctgggaagggaccctgggctgtgtctcctccctgtaccgtgtcaactccaagagctggcaccaggccgggagggctattcccatattcctcacagctggcttgtaaggcaggagctggcccaggccacagcacctgctggggtgggaaagggccccagctgacctggctatgggtgccactggagctagaacagccctcctgcacccaggctggcgacagcccagcagtgcccacacaggactgggccctccgcaggggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctcttgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaa

SEQ ID NO: 126458 - DNA, 1063 bp, Homo sapiens
  Payload ID: 4794
  Gene Symbol: DERL3
  Gene Name: derlin 3
  Uniprot ID: Q96Q80
  ENST ID: ENST00000406855
  CDS Start-End: 20-739
gcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctcttgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaagaaattgaacatgacctgttgaagaaattgaa

SEQ ID NO: 126459 - DNA, 969 bp, Homo sapiens
  Payload ID: 4794
  Gene Symbol: DERL3
  Gene Name: derlin 3
  Uniprot ID: Q96Q80
  ENST ID: ENST00000476077
  CDS Start-End: 26-643
ggccacgcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgcaccttgtgttccggaagttccaggtctggaggctcgtcaccaacttcctcttcttcgggcccctgggattcagcttcttcttcaacatgctcttcgtgttccgctactgccgcatgctggaagagggctccttccgcggccgcacggccgacttcgtcttcatgtttctcttcgggggcgtccttatgaccctgctgggactcctgggcagcctgttcttcctgggccaggccctcatggccatgctggtgtacgtgtggagccgccgcagccctcgggtgagggtcaacttcttcggcctgctcactttccaggcaccgttcctgccttgggcgctcatgggcttctcgctgctgctgggcaactccatcctcgtggacctgctggggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgca

SEQ ID NO: 126460 - DNA, 3113 bp, Homo sapiens; identical to SEQ ID NO: 126457
  Payload ID: 4794
  Gene Symbol: DERL3
  Gene Name: derlin 3
  ENST ID: ENST00000614504
  CDS Start-End: 20-556

SEQ ID NO: 126461 - DNA, 1063 bp, Homo sapiens; identical to SEQ ID NO: 126458
  Payload ID: 4794
  Gene Symbol: DERL3
  Gene Name: derlin 3
  Uniprot ID: Q96Q80
  ENST ID: ENST00000620697
  CDS Start-End: 20-739

SEQ ID NO: 126462 - DNA, 969 bp, Homo sapiens; identical to SEQ ID NO: 126459
  Payload ID: 4794
  Gene Symbol: DERL3
  Gene Name: derlin 3
  Uniprot ID: Q96Q80
  ENST ID: ENST00000628868
  CDS Start-End: 26-643

SEQ ID NO: 126463 - DNA, 860 bp, Homo sapiens; identical to SEQ ID NO: 126456
  Payload ID: 4794
  Gene Symbol: DERL3
  Gene Name: derlin 3
  Uniprot ID: Q96Q80
  ENST ID: ENST00000631305
  CDS Start-End: 18-725

SEQ ID NO: 126464 - DNA, 7237 bp, Homo sapiens
  Payload ID: 4795
  Gene Symbol: DSE
  Gene Name: dermatan sulfate epimerase
  Uniprot ID: Q9UL01
  ENST ID: ENST00000331677
  CDS Start-End: 445-3321
ctgcttctctataggtgacccccgccccaaagtcccccctcccactaacttctctttgagaagagagtaaaaccgaattcgagagaaaagaggcagtaactattcgggaggaggcagactggagtgggcaccagtcccgcggagcctcagcgcccgccgcgtccctccctccgcccctttcgcccacacctacccgcccccgccggcccggctctcagtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaattttctctagtattcttcttctttgttccattatattcaaaatgcattaacattttccaaaatttttgaagagagatctttatttggacgtgtattcattaaatatataaagtagtgtttgaatcaaaagaagtattttctctgcttattaaccttaattgttgtttaagcatattttaaatatttaaaacaatagccaattctgatatttaagtagcacccaacttttaaaagcataaaattttcaatcaactcctcagaaggtaacagcagcatagaatactagaaaaataatccatagtttctacttgagcataagaaaatgatatacttaaaaggaacttaataaattatcatacattcagcatatttgagtcatatatttctcctttgaaacaaaatatgttcagctcaaattttacagtaaggacacactcactgatttataggtgtaaagtaacaacagtaacctttcctcttacttgctcttttagttcacagcaataccagtatgtaaccaaaagacaagctagagaaacttttaagtacctttctgcagttctaatttgaaccttcttgcataaagaaaacacaagtttgacttttaactgtgcttcacttattatgcttggaatctagaaaacgacttctgaggaagtaatttttttcccctctcatggaaagtctctagggaggatgtcattacacactgtttaaaagaataatgttttcaaaagaataatgcttccgtttgtcctgcatggatgctcttactaggatttaaacttgctttatgtgacagattctccatttacttaacctcactcaacattcctctcttttactctttctcactcaaaaggatgaactgtctgaaatgatcaaaaggaaattttgaaagaaaaaaaaaaggaaaattattctttgaggttaccaagcaaacctgatctcagatccaaactgagacatactttctaacagagatgaaaagtgcaagtgagtgccaaactcgcttttcttttgttttcattaggttaaggcttgacaatacgttagtcgccacagcatgatccagtgtaacatattagttcattttaaagtagtctttttaaaatacgcatctttaaaacaaaatgaattaaaattatgtgttttttttttttcttctaatgaacctggtatttatttccttaaaaagaaacttcctcaggcagtgacttaagtggttaagtgaaaaaaaaaaatgctgaaacaaatcacccctcttcataatgaaacatgttttttttaatcagggatagtgcatatttgagtaaaactagggaactttttgtaacttgaaaacaaagcaatgttaaatctcccttgaaactgagtaatcagttatggaatctgtttcaatgctgctcactatgacaggaatgtttcaagttcatttgataatatgtgagctgttgttcaggggattggcaggactcttggtcctagccttaaagaaaatttgagaatcactagcatacagagcttgtcagtgcagtaaaagtggtatattcctgggaagctgaggtgggagtattgcctgagcttaggagttctgtgctgcagtgagctatgactgtgccactgcactccagccttggagacagagtgagaccgtgtttctctcttttttttttttttaagtatattcccttgtttataactgattagcttatttcagttgatggtagatgagacctatggtggtggatgagacccagaattttcagagagaacattcttttgacaacattgttttaatcgtcaaagtcaggtggaagaccgtgttctggaactattttaattgttaaaatgtatcacctaagataatgaattcttccacaaatattttagtcatagtttttaagtaccacgtattctaaggttatcagaaaatatgtcttaacagaatgttttgcatactgaataatttgtttttgaaaaggaaaatttacatttgacttactcagtttttaaaaaattatttttatttctagagacacggtcctttctgcatcacccaggctgaagtgtagtggcgtgatcgtagctcactgcagccgcaaacttcccatcttaagcgattcttctgcctcagccttccaaagtactgggattagaggcataggtcatcatgcccggccaagttaaaaaaatttttgatagttcacaaaccactcacaaaagaatctgaaatttctccaagtgttaagagaaagcaagctatgaaatgctatatttgtaggcttaaaagtaaattagtgtgttttcttaaaaatctaaaccaagattaaaatgaatatagtcataggtatgaggggcatgtaatttatcttccgactggagatacctttgagagttaaaggaggagcaattaattgttattccaggacaacagatataaatcgagattatactaggtgaactgggacatatggtcatctttgtcatagcttaattcaggaaaaaaggagttagggaagtctgaaggtctaactcaaagtttgatgctttttaagcaagtttagggaacttgagatgacctgattgagacccctaaatctacagatgaggaaagcaagcctcaagcaaggggggcctgatcctttccctgttcgctgtgtattccctgtctgtggcaaagcccattgccttgattctcttctctttactttcatgttgagaagtagtttctttctgcagtttatttaatttactggcaaaatgacgtatttttttttcagcaatgtttcagctagatatttgctttatgcatgtaatgtcaatgaagtactcataagttttcaagaaatgactgatataaatcatgtgttccactacatagtctaaatatttagtatttggtcatctattttaatatgttcaaattctgttaaacaagacatagtcactatgtgaagaataaaaatagacaaagttgca

SEQ ID NO: 126465 - DNA, 4037 bp, Homo sapiens
  Payload ID: 4795
  Gene Symbol: DSE
  Gene Name: dermatan sulfate epimerase
  Uniprot ID: Q9UL01
  ENST ID: ENST00000359564
  CDS Start-End: 229-3105
agtagcgtcgcccgaggctgcagcagcgcatcccggggcatggcgcggcgggggcgcggagggctcggttcggagggggccgggagcccgggcgccctggagtgaggaggaccgggagctggctctggaggctgcggaggcgacgccggagagaacgaagcctcggctgggagcggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtg

SEQ ID NO: 126466 - DNA, 1130 bp, Homo sapiens
  Payload ID: 4795
  Gene Symbol: DSE
  Gene Name: dermatan sulfate epimerase
  ENST ID: ENST00000430252
  CDS Start-End: 699-1130
ctgcgcggttgactacgcttatcaatccatcgtattcctttgtcttcttgtcacaaaaagaatttcgtcagtctggaaggggagttttacttacgtaaatggatgtagaccagactcaagcatggctgccctgaagggcagacaggtttattgggcaacagctgggaaaatcagcggttggacttggccacatgctccaagaaggccacacgtccttcttcttaatggcataggagttggaggagcccttggcagcattgatgagctcctctgccaggcactcagcaatggtcttaatgttccggaaggcagcctcacgagcacctgtgcacagcagccagatggcctgattcacacggcgaagtggggacacgtccacagcctgtcgtctcacagtcccggcgcacccaatgcgtgtggagtcctcccggggaccactgttgatgatggcgttcaccaggacctgcagagggttctcgcctgtgagcaggtgtatgacctcgaaggcatgcttgacgatgcacacagtcatgagcttcttgccgttgttgcagccgtgcatcatcatggagttagtaaggcgctccacaatgggacactgagctttgtggaagcatttggcggcataccaccctgcactgtgaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgct

SEQ ID NO: 126467 - DNA, 10586 bp, Homo sapiens
  Payload ID: 4795
  Gene Symbol: DSE
  Gene Name: dermatan sulfate epimerase
  Uniprot ID: Q9UL01
  ENST ID: ENST00000452085
  CDS Start-End: 195-3071
gcggacgacccaccttgagatgcatctagcgactgctcccagcatgtaggagcagttgtaaaatcacagccgtaacagtgcctgctctccagtgtctgaaaacaaatgtttttctggtcttcacttttttgaggcaggaaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccttggaatacctccctccctgggatcccaaggactacagtgcccgctggaatgaaatttttggaaacaacttgggtgccttggcaatgttctgtgtgctgtatcctgagaacattgaagcccgagacatggccaaagactacatggagaggatggcagcgcagcctagttggttggtgaaagatgctccttgggatgaggtcccgcttgctcactccctggttggttttgccactgcttatgacttcttgtacaactacctgagcaagacacaacaggagaagtttcttgaagtgattgccaatgcctcagggtatatgtatgaaacttcatacaggagaggatggggatttcaatacctgcacaatcatcagcccaccaactgtatggctttgctcacgggaagcctagtcctgatgaatcaaggatatcttcaagaagcctacttatggaccaaacaagttctgaccatcatggagaaatctctggtcttgctcagggaggtgacggatggctccctctatgaaggagttgcgtatggcagctacaccactagatcactcttccaatacatgtttctcgtccagaggcacttcaacatcaaccactttggccatccgtggcttaaacaacactttgcatttatgtatagaaccatcctgccagggtttcaaaggactgtggctattgcggactcaaattacaactggttttatggtccagaaagccaattagtgttccttgataaatttgtcatgcgtaatggcagtggtaactggctagctgaccaaatcagaaggaaccgtgtggtggaaggtccaggaacaccatccaaagggcagcgctggtgcactctgcacacagaatttctctggtatgatggcagcttgaaatcggttcctcctccagactttggcacccctacactgcattattttgaagactggggtgtcgtgacttatggaagtgcactacctgcagaaatcaatagatctttcctttccttcaagtctggaaaactggggggacgtgcaatatatgacattgtccacagaaacaaatacaaagattggatcaaaggatggagaaattttaatgcagggcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagatagctgtattttattatggttgtactcttcttgttcccaatcacagtgttagcactgaagctataaattacctggtcattttgtgatcacaagagtctatgcaaaaaaaaaaatttctttaccccagattatcagatttttttccctcagattcattttaacaaattaagggaagatattttgacacaagaaagcaggaacgtggagaaattggagcaggaaaagaaattatcaaagcaatagaaatagcttggtggtcctatggtgtttttggaagtatttggcattgctaattgagcagtccatatagtactacttttagaagaaacaaaaagtctattttttaaagtaatgttttttcttatgagaaaaaggtttagatagaattgggttttattaatattaatttaatgctattagcaatttccatatactatattgtggaaaagactgaagaatacaattctgagaaatataaaaaaattttaatggtatactcatgttgaaagataaatgttgctaagtcctggtatgatggtgtgagcttccttggggaagtacttcttgagttatgtaactaacaggatgttttactacagatctggatggctattcagataacatggcaaaaaatgatagcagaagatcattaaaaacttaaaatatattttattagaaaacatttatctatgaatgaatatttccttgatgctggtctctgcacacatatgcttggttacttgcatgcattcattggttgttcaataagtgagatgattacagataatactgtattttccttatatggaaaaccgttatagacccaataacaactaaacctttcaaaagaaaatattttctattatgaatgttgattttcataccaaagaagatggagagtctaaaatttggatatgattcttatgtttttttaatagaaaaccttcttcaagtttattttcctaaataaacatcataattgtgaattttctctagtattcttcttctttgttccattatattcaaaatgcattaacattttccaaaatttttgaagagagatctttatttggacgtgtattcattaaatatataaagtagtgtttgaatcaaaagaagtattttctctgcttattaaccttaattgttgtttaagcatattttaaatatttaaaacaatagccaattctgatatttaagtagcacccaacttttaaaagcataaaattttcaatcaactcctcagaaggtaacagcagcatagaatactagaaaaataatccatagtttctacttgagcataagaaaatgatatacttaaaaggaacttaataaattatcatacattcagcatatttgagtcatatatttctcctttgaaacaaaatatgttcagctcaaattttacagtaaggacacactcactgatttataggtgtaaagtaacaacagtaacctttcctcttacttgctcttttagttcacagcaataccagtatgtaaccaaaagacaagctagagaaacttttaagtacctttctgcagttctaatttgaaccttcttgcataaagaaaacacaagtttgacttttaactgtgcttcacttattatgcttggaatctagaaaacgacttctgaggaagtaatttttttcccctctcatggaaagtctctagggaggatgtcattacacactgtttaaaagaataatgttttcaaaagaataatgcttccgtttgtcctgcatggatgctcttactaggatttaaacttgctttatgtgacagattctccatttacttaacctcactcaacattcctctcttttactctttctcactcaaaaggatgaactgtctgaaatgatcaaaaggaaattttgaaagaaaaaaaaaaggaaaattattctttgaggttaccaagcaaacctgatctcagatccaaactgagacatactttctaacagagatgaaaagtgcaagtgagtgccaaactcgcttttcttttgttttcattaggttaaggcttgacaatacgttagtcgccacagcatgatccagtgtaacatattagttcattttaaagtagtctttttaaaatacgcatctttaaaacaaaatgaattaaaattatgtgttttttttttttcttctaatgaacctggtatttatttccttaaaaagaaacttcctcaggcagtgacttaagtggttaagtgaaaaaaaaaaatgctgaaacaaatcacccctcttcataatgaaacatgttttttttaatcagggatagtgcatatttgagtaaaactagggaactttttgtaacttgaaaacaaagcaatgttaaatctcccttgaaactgagtaatcagttatggaatctgtttcaatgctgctcactatgacaggaatgtttcaagttcatttgataatatgtgagctgttgttcaggggattggcaggactcttggtcctagccttaaagaaaatttgagaatcactagcatacagagcttgtcagtgcagtaaaagtggtatattcctgggaagctgaggtgggagtattgcctgagcttaggagttctgtgctgcagtgagctatgactgtgccactgcactccagccttggagacagagtgagaccgtgtttctctcttttttttttttttaagtatattcccttgtttataactgattagcttatttcagttgatggtagatgagacctatggtggtggatgagacccagaattttcagagagaacattcttttgacaacattgttttaatcgtcaaagtcaggtggaagaccgtgttctggaactattttaattgttaaaatgtatcacctaagataatgaattcttccacaaatattttagtcatagtttttaagtaccacgtattctaaggttatcagaaaatatgtcttaacagaatgttttgcatactgaataatttgtttttgaaaaggaaaatttacatttgacttactcagtttttaaaaaattatttttatttctagagacacggtcctttctgcatcacccaggctgaagtgtagtggcgtgatcgtagctcactgcagccgcaaacttcccatcttaagcgattcttctgcctcagccttccaaagtactgggattagaggcataggtcatcatgcccggccaagttaaaaaaatttttgatagttcacaaaccactcacaaaagaatctgaaatttctccaagtgttaagagaaagcaagctatgaaatgctatatttgtaggcttaaaagtaaattagtgtgttttcttaaaaatctaaaccaagattaaaatgaatatagtcataggtatgaggggcatgtaatttatcttccgactggagatacctttgagagttaaaggaggagcaattaattgttattccaggacaacagatataaatcgagattatactaggtgaactgggacatatggtcatctttgtcatagcttaattcaggaaaaaaggagttagggaagtctgaaggtctaactcaaagtttgatgctttttaagcaagtttagggaacttgagatgacctgattgagacccctaaatctacagatgaggaaagcaagcctcaagcaaggggggcctgatcctttccctgttcgctgtgtattccctgtctgtggcaaagcccattgccttgattctcttctctttactttcatgttgagaagtagtttctttctgcagtttatttaatttactggcaaaatgacgtatttttttttcagcaatgtttcagctagatatttgctttatgcatgtaatgtcaatgaagtactcataagttttcaagaaatgactgatataaatcatgtgttccactacatagtctaaatatttagtatttggtcatctattttaatatgttcaaattctgttaaacaagacatagtcactatgtgaagaataaaaatagacaaagttgcattatgacttttcttcttgcatatacagtttccctcttggttttgggatttttttaattgaagttttatttggcataaattatgaacatacatgattgaaaaagtatagtactagaagccttatttaaaaaacaaaacaataaattatctgtcccttcccctctcattcttagtttgtacttcccagaagtaaccaatttctaattcttttggctgttacatatattgtgtacttgtttacaataaggtctaaaactgcctactaatgaagctttagctctcttacccattctttatacttattggaagataataggtgctatggaaggaaaagtcagggtaaggagactgggaagaggaggccataattttaaatgtggtgatcaggttaggctttattgatgtctccacttccattctctgtgtcattttgaaaatctatttgctgttaatttaatggggttttaggaaggaactgaaggaaatttatatattgagtgcagtatgtttaaatggaagtcccacagcacttttcagttgagttaacaaataacgaatgacaataacatgtttacagagcatctactatatgccaagtattgttttaggaactgaagatatggtagagaataggaataataaaagctggcccttgtatagtttatgttctagtgggagcaaataataacagtaatagtgcaggatgtcaagtagtggtaagtactgtggagaataaagcaaggggaggggatgtaaggtgatggtgaattggtactgtcccataaacagtggtttctgatgtgattacttatgatcagacacttgaaagaaataagggaatgaatcacagggacatctaagagagaggagcattccagatagaacagcagttcgaaggccctgagctcagtatgtgtttggtgtatttaggactaggaggccagtgtggctagagcagagtgggggaggggagggtgataggaataggatcagatcatacatgctctcacagactgcagcaaagacttggattatgagttggggagtcagttgcaatgaactgagatgtggctgactgcaggaggaataagtagtaggaagcgggtccaggaggttgttttagccatgttaagtttaagatactttctaaaaatccaagtggagatgtaccagcctggaatccaggggcaggctgtggctgaagatgtaattgttggtgccttcttaaaggttaaacagaaatttactagctgtgtgagaggagaagtgcattctgggtaaatggaatagaataaagaaaaaagtacgaaaaagcaaacctggttcaggaattctccagactggtggtgttggcccacagggtgtgtgatggagaatgggtgaagatgaaactgaaaaggcaagcagggaggctattgtgcaggactttgtaggacatgctaaggaatctggactttattctgccatgaggctgctcaaccatttttatgcctcagcataactgagggctacaacataacacccatcactcaacaagcatggcagcgattttcatgggataggaaatgtgtatgggagcaaaagggacatgggtgaggggtgttgatgatgccacatatacctgtgtgtatgtgaaactttgaaaaatccctgagatggctctgatatgccccccatattccatatgtttactccctggggtgaggtggggcagggagggggtaccctctgcttagaaatcgctgcaagcaatggcaagccattaaagaattttctttttaaataatcagatttgcattttagaaaggcaattttagcttcagtgtagagagtggacccaatggggaagaggttaggagaccatttccatagtctgggtagaagacaattagctccttgaataagtctggagagggaatgtttaactcctagcccacaggcaaaatgtgtggccaaaggaatgaatattttgtggaagtattgatcagaaagataatgagtcaaggatccctaatggtatatatgtctgagtcttatttaatataagaagagcatggttgcctgccatggctctgctgccgtcaccctggctatcccttaataagcccaggaaattgttcaaatatttctgccatttgtgttttcagcttgccttgttcagggacttcacatagaatggtataactggagtacagggtgtgtatgtagtggcgggtgatagaaaattagactggaaaagtagaccaggctccagggcaggagggtctcttttcctcactccatttaatttaaaaaagaaatagtttcaattatataagcattgtgattaatgcaggcagttggagtactttctaaatcagaaaagtaaaagtgctgctccttctgcatatctctagaaatttgttatggggaagtctttatcaaagaatgtccctatgatttcagtagaatttcttaagaaaagagcttctaaaaacattcagtcagcccagcacattccaaattaaataatgagaagtgtgtttagtatttatttaggaattcttttctgaacaaaaaaacgttttcaatggtctaggcacttcctttttcttccaaagaaatggtaataacaggacactagaagtacctttctgtgtaaagcaaacatcttgtcagttttccttactttgtacttttcagtctctgctgtttaccatttttgtccaggatcagagacctccagtaaaataaaaggaatttctgtttattgtctccttgataatcttgatttctaaactcctttactcctctcttgaaggtatttgttttactgacaaaagaatggatccaggtcatttagtagagttctgaagagaattcttagagcactctatatattcaaacctccgtattttttgatacaaaaaggactgatgaaagggagacgtgattcttttgaaagattaattcacagaattttttatcacagttgaaatatcaattgcaataacaactgaaaactgattgctattactgaacactgcccttaggtggctcactcttagaagacacaaagtcactggactacaatcctttagggcagggattgtgtctcttgctcgttgtatatacatggttcttacacagtgcctggcattcaaaaaatgcattcagaaaaatttggtattcaaaaaatgcttgatgaattgactgactgcctgaatgaataaataaattggtggattaatgactgaatggagtacagaagactgtggtcccagaagaccttaacattgagcttgctgcagactgaatgtttgcctcctctcaaaattaatatgttgaaacctaatccttaatgtgatagtattaggatgtggggcctttggaaagtgattaggttatgaaggtggagccctcgtgaatgggagtagtatccttataaaagataccccagagaggtcccttgtcccttccaacatgtgaggctacagtgaaaagatggccatctgtaaaccaggaagtgagtcctcaccagataccacatctgttgtgctttgatcttggatttccctgtccccagaactgtggtaaataaatttctgttgtttgtaagcc

SEQ ID NO: 126468 - DNA, 9531 bp, Homo sapiens
  Payload ID: 4796
  Gene Symbol: DSEL
  Gene Name: dermatan sulfate epimerase-like
  Uniprot ID: Q8IZU8
  ENST ID: ENST00000310045
  CDS Start-End: 1475-5143
acctgctttcggccccgccccgcccgccgccggcctgctcacggctcctcccgtcctccccgaagccccgcctctgaccccgccctgtcctgtctccgtcccgccccacgcccgccagccagcgtcgctgtctctcgccttccctgaggccccgccttcagccccgccttcaaccccgccccgtcctgcctccgccccgcccccgcttgccggcccgcgtcgccgtctcaccctccccgggctgcgcggccggagctggcacagaggatcctcggccgcggcgacatcaccgcctgggcacgcgggcgctgctctggatacggcgccaccgagagaacccgccgcccgcgggtctctgtcctgcggtccgtggttgcccccacaagcgtccggcgtttcctgagggcgggcgtgtccgggccgtgcgggtcgcggggaccgagcgcggctgaggagaccgagctggggcagcgcctgccgtagcgcgggagacgacgcgggggtcttgcggagccccgcgggagcctggcccgccgtgcagagcagttttctggaactctccacctccgtctcccttggggcccagtgcggcgccgagcccccgtcgggatctgcctgagaaaagtgtcatgaaaaaagagcagaagagagacctcactgttgctgaaaggggaattttctttccccgttggcggttacttcatgatcggacgagaagtatctaggtgactgaagatattccatttttatgtttgtacacatgaagctgataaaagaagatgtgaacatgatttctctttgtcataataggctgatgagtaagtaagcctgaaaaatatttgaaatgaaggcaagaattttgaatttttaaaaaccaactaagactttgatcacttgttgaggatgtttctctctcataaatgaaagaaaaacgtattcacaagacaagaagtataaaaagttgagaggaatgacaactgagtccactcactcgaagaatgtcagtacttcatcatcttctttgggcaaacatacacaaatgcatcatacatgtgtggtgagcttatcaccagtgatggttttctgtgctagaaatgactcttaatttgaattttggagtgctttttctctttttttacaatgtgtgttccaactctttgtgttaaatagatttaagtaaaggaggtaaatgctaaattcatagtgttttttacctgtatcacttccctgtgtattatggaaaaattagagattttaacgttattcaaagttttactggaagcaaaactgtgccagggacagagatatacaatttaagttttctctttttggcaactgcacttgcttaaaatgtactgaatgtcagctggatttcacagcatatcagatttacagtctttgtcttatcaaggcctttactgtatgttttatactaaccagatgggaaacacattgagcatcatatctgacatgtatgcctaagggaggagctcccccatggatcatggcgttaatgtttacaggacatttactattcttagcattattgatgtttgctttctctacttttgaggaatctgtgagcaattattccgaatgggcagttttcacagatgatatagatcagtttaaaacacagaaagtgcaagatttcagacccaaccaaaagctgaagaaaagtatgcttcatccaagtttatattttgatgctggagaaatccaagcaatgagacaaaagtctcgtgcaagccatttgcatctttttagagctatcagaagtgcagtgacagttatgctgtccaacccaacatactacctacctccaccaaagcatgctgattttgctgccaagtggaatgaaatttatggtaacaatctgcctcctttagcattgtactgtttgttatgcccagaagacaaagttgcctttgaatttgtcttggaatatatggacaggatggttggctacaaagactggctagtagagaatgcaccaggagatgaggttccaattggccattccttaacaggttttgccactgcctttgactttttatataacttattagataatcatcgaagacaaaaatacctggaaaaaatatgggttattactgaggaaatgtacgagtattccaaggtccgctcatggggcaaacagcttctccataaccaccaagccactaatatgatagcattactcacaggggccttggtgactggagtagataaaggatctaaagcaaatatatggaaacaggctgtagtggatgtcatggaaaagacaatgtttctattgaatcatattgttgatggttctttggatgaaggtgtggcctatggaagctacacagctaaatccgtcacacagtatgtttttctggcccagcgccattttaatatcaacaacttggataataactggttaaagatgcacttttggttctattatgccacccttttacctggcttccaaagaactgtgggtatagcagattccaattataattggttttatggtccagaaagccagctagttttcttggataagttcatcttaaagaatggagctggaaattggttagctcagcaaattagaaagcaccgacctaaagatggaccgatggttccttcaactgcccaaaggtggagtactcttcacactgaatacatctggtatgatccccagctcacaccacagccacctgctgattatggtactgcaaaaatacacacattccctaactggggtgtggttacttatggggctgggttgccaaacacacagaccaacacctttgtgtcttttaaatctgggaagctggggggacgagctgtgtatgacatagttcattttcagccatattcctggattgatgggtggagaagttttaacccaggacatgagcatccagatcagaactcatttacttttgcccccaatggacaagtatttgtttctgaagctctctatggacccaagttgagccaccttaacaatgtattggtgtttgctccatcaccctcaagccagtgtaataagccctgggaaggtcaactgggagaatgtgcgcagtggcttaagtggactggcgaggaggttggtgatgcagctggggaaataatcactgcctctcaacatggggaaatggtatttgtgagtggggaagccgtgtctgcttattcttcagcaatgagactgaaaagtgtatatcgtgctttgcttctcttaaattcccaaactctgctagttgttgatcatattgagaggcaagaagattccccaataaattctgtcagtgccttctttcataatttggatattgattttaaatatatcccatataagtttatgaataggtataatggtgccatgatggatgtgtgggatgcacattacaaaatgttttggtttgatcatcatggcaatagtcccatggccagtatacaggaagcagagcaagctgctgaatttaaaaaacgatggactcaatttgttaatgttacttttcagatggaacccacaatcacaagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttcccctttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacagaacttgcctagagatgaaattaaactaattgaaaacatctgctggactctgatggatcgcctaggatatccaaagtttatggactaaatgctgcaggtcagcagaaatttgcactaataatacttaccaacccactttgtggatatgaatcagaagagtttgtttattctttagtgtgtgtgtgtgtgtgcacgcgtgtatgtgttcagtgttgtttgcacagagagattgttttaaaaaatggcaccatatttggcctagcaggatttatttttatgtcatcacctcccttgcctttgtttctgaaaattttgtctgctaaaaagtttctgctacagagtggtagatgaagttatatcatggggtcaggggagatgggaaaattttaagtttttgtctaactccccttcatctgtaactgtgctaatctatctagagacctcaaacactgctaaaggccttgcaattgctgctttacccacgcatctcttgctttcaagatggactacaaaagttccttatccttttgaaaaggtcttctgacacacttatcttgcacaaagaaaaagaaaatttcttttactgtgtttaatgttcagtgatatcactgaggaaatggtgaaagctcctatcagaactataggatttcttctgggaaatacagatggaaatacagaatgaatatgtttttttgaggtcggaaactgactttaaaagcctccttgaagttttttacttagaaatataaggaataagtctttgaacaatctgggtggcaagggctggtagattattttagacatgattgtctgtttaaaactctcctttcactttttatcctccctggagctacagctgttcgccatcacatcactcccatcctatcctttctgtcactgtcaagcaaaacaatcagtagttactaatcgctgaactctcaatattgtggggcattttccccccagttgattaattttgcgttaaagactgacacagacttagaatcaaatttatttttctggaattaacactctgtgactcaaagtagtgccactgcagtgtctttttaaactggaaacagaattggaaaactgcctgacttatcttgcatccctttgaatgagtttacagactgccagtgtctgcaaaagttgaaagcaaatgggagatgatgtcagaggcatctgtttcctttaccatctgcatcttattataaatgtagtcgtcataaagtgtggtttattttattttggtaggctctgaaatcaaaatgctacgccattataagccagtggagtaattacaatgtattggatgaaaacataaggcagtgtggagacttgatgaaaatctctgtacagattgcagtcttcttcctgatgtttcaaactgtggttcccccaagctctctaacacttggaagtctgtcattctgacctagataaaagtggttctttctcagtagttattattatgtcaaaatgtgcctccagagtgataaagctctgtatatgttagattccagctaaacctaacttggctgtcatttttcttccattatagtgtgagtggagactgccccccctccccaacatattccttcccatatctctcatgattgtccctctgtaatttcaaaatgaatgaaattcatgtgaatgtaggttgagagggcactgaagacctgaatctacactagtaatctcaagaaagattattcattctatctcagagttaccggcaagcatataaaatgctacttggataatatctacatgaatattgcatgctacatggttgataacactatttccattattgggcagaatctcagtgtttactttcaattcctaggatatgtgatcgtgaatcagatcacatataaaaagtctggattgtcagtagtattagatctgatcaaggtaggaattacaattgcatgcaggtagcaagcaagaaagcagaaactactgttccctttattttaacattgtacagacaatacagaaatgtacctgttggcggccgggtgcagtggctcacgcctgtaatcccagcacttcgggaggccgaggcgggtggatcacgaggtcaggagatcaagaccatcctggctaacacggtgaaaccccgtctctactaaaaaaaaaagtacaaaaaattagccgggcgtggtggcgggcacctgtagtcccagctacacgggaggctgaggcaggagaatggcatgaacctgggaggcagagcttgcagtgagtggagatgcgccactgcactccagcctgggcgacagagcgagactccgcctcaaaaaaaaaaaaaaaagaaaaaaagaaatgtacctgttggcaggagaaggccagatggagtatgtggagtaatagggaaagaagagttacagaaaatgaaaaagaaaatgagttacactgagaatgaatatgggaacacgtcattgatagcaaaagaaaggtacaggcttacgaaaatgatctttacaatgtatcccagctttcacccccacatggcaatgcagagttgtatttacttgtttctgtactcacctactcccaccccaagggaaaattttagacatgaaccctactatttagttattctaaaatagaaagtttgctggagaaagcgtccactcacagattgttctgtaaggaatgttatgtatgggtgagcgggtgacacatccattgggtatgtatgcatgtgatggtgcctgagacccctgccttagaaacagaattcctaaggggattgactctcccagcatgttcccaggtcctgcacccttagggtgatctaggaaaattttaaatagcttctactcttatttttgttctttgaaataattaaaagagggattatcactatctgatacttctgaaagaaacacttacaaaatttcttatctgtaaaatccgtctttttctacattaacttccccaaacataggcctaattgagataattgcttttattataataataggattgaaattttaaaattttgaaaggacttattaattttgctgacaaaagtgaagtaacaaatataatgataattggctttttaaattttcaaacaacatagatttactcaagatgaaataaaaaggccatattcagagttgaatttaatgaaaactcagaggaaataggaaaatctgctcaggagaaagaagctaaatctgcatagatttagtttgtagaatttaatttaaaatttaaattttaacaaagtgatgacacaacaatatgtacgtttaggtgtggacaccaaaatattagacatttgattgtccttttacatagagaataactaataaatgcctgacaagaatgggacaatccttccttgtatcaaaattcccaggtcttgctacattgccctctgcaaatgtattcaaagaagaacctcctccaccacttacttttggttggcataattgttcagcaacgatttctgtacatcaccaagtatctttggcattcttggtatacaaagtatatcacaattttaagtgagtaaatattaatgataatttttgaattgctttgtttggcttgattaactttgatcagaaatagaaacgttttcatttgttgatttaggaaaaagcataaatagaatgcagtataacaccacttccaaaggtaaggatacctaacattcttttttttttttttttttttttttttgggatggagtctcactttgttgcccaggctggagtgcagtggtctgatctcggctcactgcaacctccgcctaccgggttcaagtgattctcctacgtcagcctcctgaatagctgggattacaggtgcacgccaccatgcttggctcatttttgtatttttagtagtgacagcgtttcaccacattggtcaggctggtctcaatctcttgacctggtgatctgcccacctgggcctcccaaaatgctgggattacaggcatgagccaccacacctggcaagggtacctgacattctaagatatcaagacacttaatatgtgggctattagctgcttatttaaatgttgaccaaattgtctgatatatctgattaatcatgatttcacttcatttcggaagaaaaattatccatatcatttttaaagacgcaaatgactttggatttttgcatagagtacaatagacacttcaaacaatagattctaacattctctgaaacacttgagatgtttgagctaccatttatatgggttatttatatttagtctaagtaacacatacatgtttaattgattctgttttcatggatagattcaactaagtcttccaagcaattaattttttgttcgtcgtcgtttttccttcatacgttatctagttatgcagcactggaaacagactgaagatcataaaccagttttatcagacctatgtgtaataagactcctgttaatacaaaaataaaaagctaaaagcaacttgt

SEQ ID NO: 126469 - DNA, 9531 bp, Homo sapiens; identical to SEQ ID NO: 126468
  Payload ID: 4796
  Gene Symbol: DSEL
  Gene Name: dermatan sulfate epimerase-like
  Uniprot ID: Q8IZU8
  ENST ID: ENST00000572659
  CDS Start-End: 1475-5143

SEQ ID NO: 126470 - DNA, 1786 bp, Homo sapiens
  Payload ID: 4797
  Gene Symbol: DPT
  Gene Name: dermatopontin
  Uniprot ID: Q07507
  ENST ID: ENST00000367817
  CDS Start-End: 91-696
acatctggaagccacatgtcagcggcagctatataaaacggtcagaccagcaatcttagagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttagatttgccacataccaaatctgggtgaaaggaaaggggccggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactatgctgaaaa

SEQ ID NO: 126471 - DNA, 645 bp, Homo sapiens
  Payload ID: 4798
  Gene Symbol: DCD
  Gene Name: dermcidin
  Uniprot ID: P81605
  ENST ID: ENST00000293371
  CDS Start-End: 191-523
cagccagcctttgttgacttaacaggtggctctgaggtgggagaagaggaggaggagaacacaccactggaagactggttcccattggtccctgtcatgcttaaaaaaaggcccagagaggcagtcttgacaccctagatcccaagatctccaaggatttggtggcatacccactccagcacacagaagcatgaggttcatgactctcctcttcctgacagctctggcaggagccctggtctgtgcctatgatccagaggccgcctctgccccaggatcggggaacccttgccatgaagcatcagcagctcaaaaggaaaatgcaggtgaagacccagggttagccagacaggcaccaaagccaaggaagcagagatccagccttctggaaaaaggcctagacggagcaaaaaaagctgtggggggactcggaaaactaggaaaagatgcagtcgaagatctagaaagcgtgggtaaaggagccgtccatgacgttaaagacgtccttgactcagtactatagctgtaaggagaagctgagaaatgatacccaggagcagcaggctttacgtcttcagcctaaaacctaaaaaaaaaaaaaaaaaaaaaaatttaaaacagctattaaactgaaagcatctgtaa

SEQ ID NO: 126472 - DNA, 670 bp, Homo sapiens
  Payload ID: 4798
  Gene Symbol: DCD
  Gene Name: dermcidin
  Uniprot ID: P81605
  ENST ID: ENST00000456047
  CDS Start-End: 191-556
cagccagcctttgttgacttaacaggtggctctgaggtgggagaagaggaggaggagaacacaccactggaagactggttcccattggtccctgtcatgcttaaaaaaaggcccagagaggcagtcttgacaccctagatcccaagatctccaaggatttggtggcatacccactccagcacacagaagcatgaggttcatgactctcctcttcctgacagctctggcaggagccctggtctgtgcctatgatccagaggccgcctctgccccaggatcggggaacccttgccatgaagcatcagcagctcaaaaggaaaatgcaggtgaagacccagggttagccagacaggcaccaaagccaaggaagcagagatccagccttctggaaaaaggcctagacggagcaaaaaaagctgtggggggactcggaaaactaggaaaagatgcagtcgaagatctagaaagcgtgggtaaaggtggggaagagaggttggtctttggggctcctgtgaatctaacctccatccctctgacttctgtgagccgtccatgacgttaaagacgtccttgactcagtactatagctgtaaggagaagctgagaaatgatacccaggagcagcaggctttacgtcttcagcctaaaacctaaaaaaaaaaaaaaaaaa

SEQ ID NO: 126473 - DNA, 773 bp, Homo sapiens
  Payload ID: 4798
  Gene Symbol: DCD
  Gene Name: dermcidin
  Uniprot ID: P81605
  ENST ID: ENST00000546807
  CDS Start-End: 191-424
cagccagcctttgttgacttaacaggtggctctgaggtgggagaagaggaggaggagaacacaccactggaagactggttcccattggtccctgtcatgcttaaaaaaaggcccagagaggcagtcttgacaccctagatcccaagatctccaaggatttggtggcatacccactccagcacacagaagcatgaggttcatgactctcctcttcctgacagctctggcaggagccctggtctgtgcctatgatccagaggccgcctctgccccaggatcggggaaccataaacaaatggattgtttacagctacagaagcccccttcagagactgccaaatttctgtcctcatccaccaacctgcctagaagagagaagctagtgccctctgcaaaacctccccacactagggggctggtataagggatgaaaactagggggagtctctttaagcttgccatgaagcatcagcagctcaaaaggaaaatgcaggtgaagacccagggttagccagacaggcaccaaagccaaggaagcagagatccagccttctggaaaaaggcctagacggagcaaaaaaagctgtggggggactcggaaaactaggaaaagatgcagtcgaagatctagaaagcgtgggtaaaggagccgtccatgacgttaaagacgtccttgactcagtactatagctgtaaggagaagctgagaaatgatacccaggagcagcaggctttacgtcttcagcctaaaacctaaaaaaaaaaaaaaaaaa

SEQ ID NO: 126474 - DNA, 1927 bp, Homo sapiens
  Payload ID: 4799
  Gene Symbol: DMKN
  Gene Name: dermokine
  Uniprot ID: Q6E0U4
  ENST ID: ENST00000339686
  CDS Start-End: 178-1608
tctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 126475 - DNA, 458 bp, Homo sapiens
  Payload ID: 4799
  Gene Symbol: DMKN
  Gene Name: dermokine
  ENST ID: ENST00000392206
  CDS Start-End: 44-343
attgcgtagttccgaataccctcggccacacctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgcccca

SEQ ID NO: 126476 - DNA, 935 bp, Homo sapiens
  Payload ID: 4799
  Gene Symbol: DMKN
  Gene Name: dermokine
  ENST ID: ENST00000402589
  CDS Start-End: 5-616
ctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 126477 - DNA, 600 bp, Homo sapiens
  Payload ID: 4799
  Gene Symbol: DMKN
  Gene Name: dermokine
  Uniprot ID: Q6E0U4
  ENST ID: ENST00000408915
  CDS Start-End: 9-281
acaagcacatgaacatgaagccggccactgcctctgctctgctcctgctcctgctgggcctggcctggacccaggggagccacggctggggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 126478 - DNA, 923 bp, Homo sapiens
  Payload ID: 4799
  Gene Symbol: DMKN
  Gene Name: dermokine
  ENST ID: ENST00000434389
  CDS Start-End: 1-604
cggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattataggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 126479 - DNA, 1293 bp, Homo sapiens
  Payload ID: 4799
  Gene Symbol: DMKN
  Gene Name: dermokine
  Uniprot ID: Q6E0U4
  ENST ID: ENST00000424570
  CDS Start-End: 7-1203
gcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcc

SEQ ID NO: 126480 - DNA, 1496 bp, Homo sapiens
  Payload ID: 4799
  Gene Symbol: DMKN
  Gene Name: dermokine
  Uniprot ID: Q6E0U4
  ENST ID: ENST00000419602
  CDS Start-End: 8-1405
ggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcc

SEQ ID NO: 126481 - DNA, 867 bp, Homo sapiens
  Payload ID: 4799
  Gene Symbol: DMKN
  Gene Name: dermokine
  Uniprot ID: Q6E0U4
  ENST ID: ENST00000414866
  CDS Start-End: 44-613
attgcgtagttccgaataccctcggccacacctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctcc

SEQ ID NO: 126482 - DNA, 1611 bp, Homo sapiens
  Payload ID: 4799
  Gene Symbol: DMKN
  Gene Name: dermokine
  Uniprot ID: Q6E0U4
  ENST ID: ENST00000447113
  CDS Start-End: 184-1494
gtggactctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126483 - DNA, 364 bp, Homo sapiens
  Payload ID: 4799
  Gene Symbol: DMKN
  Gene Name: dermokine
  ENST ID: ENST00000450261
  CDS Start-End: 16-364
cacctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctc

SEQ ID NO: 126484 - DNA, 510 bp, Homo sapiens
  Payload ID: 4799
  Gene Symbol: DMKN
  Gene Name: dermokine
  ENST ID: ENST00000458071
  CDS Start-End: 9-404
ccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaacctta

SEQ ID NO: 126485 - DNA, 1447 bp, Homo sapiens
  Payload ID: 4799
  Gene Symbol: DMKN
  Gene Name: dermokine
  Uniprot ID: Q6E0U4
  ENST ID: ENST00000429837
  CDS Start-End: 7-1356
gcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcc

SEQ ID NO: 126486 - DNA, 842 bp, Homo sapiens
  Payload ID: 4799
  Gene Symbol: DMKN
  Gene Name: dermokine
  ENST ID: ENST00000443640
  CDS Start-End: 13-774
ctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcc

SEQ ID NO: 126487 - DNA, 1111 bp, Homo sapiens
  Payload ID: 4799
  Gene Symbol: DMKN
  Gene Name: dermokine
  Uniprot ID: Q6E0U4
  ENST ID: ENST00000451297
  CDS Start-End: 1-1110
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggaccagagaagctctcgcatcccgtgac

SEQ ID NO: 126488 - DNA, 848 bp, Homo sapiens
  Payload ID: 4799
  Gene Symbol: DMKN
  Gene Name: dermokine
  ENST ID: ENST00000436012
  CDS Start-End: 13-531
ctggccttctccatgctcggaataacttcctgcagcgaccaacaggctaaagagggggaaggtctggagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccc

SEQ ID NO: 126489 - DNA, 1257 bp, Homo sapiens
  Payload ID: 4799
  Gene Symbol: DMKN
  Gene Name: dermokine
  Uniprot ID: Q6E0U4
  ENST ID: ENST00000418261
  CDS Start-End: 7-1167
gcagagatgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcc

SEQ ID NO: 126490 - DNA, 642 bp, Homo sapiens
  Payload ID: 4799
  Gene Symbol: DMKN
  Gene Name: dermokine
  ENST ID: ENST00000463292
  CDS Start-End: 82-192
ccggcctgcggtgggcagcagctcaggttctccaaatcattgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggta

SEQ ID NO: 126491 - DNA, 666 bp, Homo sapiens
  Payload ID: 4799
  Gene Symbol: DMKN
  Gene Name: dermokine
  ENST ID: ENST00000498211
  CDS Start-End: 9-119
ccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtag

SEQ ID NO: 126492 - DNA, 505 bp, Homo sapiens
  Payload ID: 4799
  Gene Symbol: DMKN
  Gene Name: dermokine
  ENST ID: ENST00000493517
  CDS Start-End: 44-154
attgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggtgagaccggcaaccaccctgtcttcccg

SEQ ID NO: 126493 - DNA, 754 bp, Homo sapiens
  Payload ID: 4799
  Gene Symbol: DMKN
  Gene Name: dermokine
  ENST ID: ENST00000464894
  CDS Start-End: 44-154
attgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggtgagaccggcaaccaccctgtcttcccg

SEQ ID NO: 126494 - DNA, 609 bp, Homo sapiens
  Payload ID: 4799
  Gene Symbol: DMKN
  Gene Name: dermokine
  ENST ID: ENST00000498593
  CDS Start-End: 44-154
attgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcaggtgagtctctgtcctcaagttaccctgcagggcccttggtcccccttggccttgctcccgggtctgggcaatctgaaattctctttca

SEQ ID NO: 126495 - DNA, 691 bp, Homo sapiens
  Payload ID: 4799
  Gene Symbol: DMKN
  Gene Name: dermokine
  ENST ID: ENST00000488762
  CDS Start-End: 16-126
cacctggccttctccatgctcggaataacttcctgcagcgaccaacaggctaaagagggggaagggatccagcaccggctcctcctccggcaaccacggtgggagcggcggaggaaatggacataaacccgggaattttaaatccaagctgggtttcatcaactgggatgccataaacaagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccct

SEQ ID NO: 126496 - DNA, 1579 bp, Homo sapiens
  Payload ID: 4799
  Gene Symbol: DMKN
  Gene Name: dermokine
  ENST ID: ENST00000490622
  CDS Start-End: 44-154
attgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcaggtgagtctctgtcctcaagttaccctgcagggcccttggtcccccttggccttgctcccgggtctgggcaatctgaaattctctttcactcctccattcaatggctttctcagccgggtgcaggatggcaggaggtggcagctgtaacttccaaggtgagacatctaccatggacccgctgggttacgtcctggcacttcttttcttggtctcctaccctcacctcccaagtaacacttgaagagttggcagaggtcttgagggcaggaggaggagtaggaggaggaggcggcggccatttgggctaggacagtaaaggcaggtgagggtgggggccctggctggctggaggagattgtataaaagaaaacacgtgacacaaggaggggagcaggcaggtgttttaggaaaggtctggtccaggcaggaaggtgggatgtttattccagagcaaaatggccttcgtccgtctgttctaaccgccatgcccacttcttccacagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttccct

SEQ ID NO: 126497 - DNA, 877 bp, Homo sapiens
  Payload ID: 4799
  Gene Symbol: DMKN
  Gene Name: dermokine
  ENST ID: ENST00000467532
  CDS Start-End: 9-119
ccttctccatgctcggaataacttcctgcagcgaccaacaggctaaagagggggaagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcc

SEQ ID NO: 126498 - DNA, 441 bp, Homo sapiens
  Payload ID: 4799
  Gene Symbol: DMKN
  Gene Name: dermokine
  ENST ID: ENST00000480507
  CDS Start-End: 84-194
ccccggcctgcggtgggcagcagctcaggttctccaaatcattgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126499 - DNA, 970 bp, Homo sapiens
  Payload ID: 4799
  Gene Symbol: DMKN
  Gene Name: dermokine
  ENST ID: ENST00000462721
  CDS Start-End: 13-123
ctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 126500 - DNA, 827 bp, Homo sapiens
  Payload ID: 4799
  Gene Symbol: DMKN
  Gene Name: dermokine
  ENST ID: ENST00000467637
  CDS Start-End: 20-625
gccacacctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagca

SEQ ID NO: 126501 - DNA, 630 bp, Homo sapiens
  Payload ID: 4799
  Gene Symbol: DMKN
  Gene Name: dermokine
  ENST ID: ENST00000460051
  CDS Start-End: 9-119
ccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtag

SEQ ID NO: 126502 - DNA, 822 bp, Homo sapiens
  Payload ID: 4799
  Gene Symbol: DMKN
  Gene Name: dermokine
  ENST ID: ENST00000464709
  CDS Start-End: 9-119
ccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggcaagtcagctaacctctccgagcctgagcttcctccagtaaaatgaggacagtgaaacctgactcacgcagccttcagttactgtacagctttccatgtcaccaccagaccaaggtgttgtggagtccagactctggagacagatgctgcataaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtag

SEQ ID NO: 126503 - DNA, 324 bp, Homo sapiens
  Payload ID: 4799
  Gene Symbol: DMKN
  Gene Name: dermokine
  ENST ID: ENST00000601650
  CDS Start-End: 1-324
gccggccactgcctctgctctgctcctgctcctgctgggcctggcctggacccaggggagccacggctgggtgggtaccgcagggtgcacagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcact

SEQ ID NO: 126504 - DNA, 648 bp, Homo sapiens
  Payload ID: 4799
  Gene Symbol: DMKN
  Gene Name: dermokine
  ENST ID: ENST00000493979
  CDS Start-End: 9-119
ccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtag

SEQ ID NO: 126505 - DNA, 271 bp, Homo sapiens
  Payload ID: 4799
  Gene Symbol: DMKN
  Gene Name: dermokine
  ENST ID: ENST00000593342
  CDS Start-End: 1-224
ctgctctgctcctgctcctgctgggcctggcctggacccaggggagccacggctggggtgcggacgcgtcatcactgcagaaacgtgcaggcagagacgatcagaactacaattacaaccagcatgcgtatcccactgcctatggtgggaagtactcagtcaagacccctgcaaaggcttcccgggtgcaacctggcctgctgcagtgggtgaagttttggtaggcaatttcttgcaaccaccaccgaggccccgaaaagcactggtcgtc

SEQ ID NO: 126506 - DNA, 606 bp, Homo sapiens
  Payload ID: 4799
  Gene Symbol: DMKN
  Gene Name: dermokine
  ENST ID: ENST00000483855
  CDS Start-End: 9-119
ccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtag

SEQ ID NO: 126507 - DNA, 582 bp, Homo sapiens
  Payload ID: 4799
  Gene Symbol: DMKN
  Gene Name: dermokine
  ENST ID: ENST00000462538
  CDS Start-End: 84-194
ccccggcctgcggtgggcagcagctcaggttctccaaatcattgcgtagttccgaataccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattataggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126508 - DNA, 712 bp, Homo sapiens
  Payload ID: 4799
  Gene Symbol: DMKN
  Gene Name: dermokine
  ENST ID: ENST00000476246
  CDS Start-End: 26-136
ccctcggccacacctggccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggatttcaaacagaacactcctttcctcaactggaaagcaattattgagggtgcggacgcgtcatcactgcagaaacgtgcaggcagagacgatcaggtgagtctctgtcctcaagttaccctgcagggcccttggtcccccttggccttgctcccgggtctgggcaatctgaaattctctttcactcctccattcaatggctttctcagccgggtgcaggatggcaggaggtggcagctgtaacttccaaggtgagacatctaccatggacccgctgggttacgtcctggcacttcttttcttggtctcctaccctcacctcccaagtaacacttgaagagttggcagaggtcttgagggcaggaggaggagtaggaggaggaggcggcggccatttgggctaggacagtaaaggcaggtga

SEQ ID NO: 126509 - DNA, 820 bp, Homo sapiens
  Payload ID: 4799
  Gene Symbol: DMKN
  Gene Name: dermokine
  ENST ID: ENST00000480502
  CDS Start-End: 33-587
ccgaataccctcggccacacctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctg

SEQ ID NO: 126510 - DNA, 414 bp, Homo sapiens
  Payload ID: 4799
  Gene Symbol: DMKN
  Gene Name: dermokine
  ENST ID: ENST00000488892
  CDS Start-End: 49-297
aaatcattgcgtagttccgaataccctcggccacacctggccttctccatgctcggaataacttcctgcagcgaccaacaggctaaagagggggaaggtctggagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126511 - DNA, 557 bp, Homo sapiens
  Payload ID: 4799
  Gene Symbol: DMKN
  Gene Name: dermokine
  ENST ID: ENST00000602679
  CDS Start-End: 274-557
gggaaggtctggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagt

SEQ ID NO: 126512 - DNA, 593 bp, Homo sapiens
  Payload ID: 4799
  Gene Symbol: DMKN
  Gene Name: dermokine
  Uniprot ID: Q6E0U4
  ENST ID: ENST00000472252
  CDS Start-End: 138-509
gctcggaataacttcctgcagcgaccaacaggctaaagagggggaagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcggagcaaaagtgaggggcaccacaggcgaacaggcaatttcttgcaaccaccaccgaggccccgaaaagcactggtcgtcag

SEQ ID NO: 126513 - DNA, 827 bp, Homo sapiens
  Payload ID: 4799
  Gene Symbol: DMKN
  Gene Name: dermokine
  ENST ID: ENST00000602781
  CDS Start-End: 2-613
catgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagccgggtgcaggatggcaggaggtggcagctgtaacttccaagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggtatgctctgggtgcgtgctctaaaggtgataaggaagaggggacctcatggtggggtgtggagaaagacccataataaagtgatctagggctggg

SEQ ID NO: 126514 - DNA, 762 bp, Homo sapiens
  Payload ID: 4799
  Gene Symbol: DMKN
  Gene Name: dermokine
  ENST ID: ENST00000460327
  CDS Start-End: 1-290
tcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggcggagcaaaagtgaggggcaccacaggcgaacaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtgcttcagtggccaccagcctcgtcacatacaccagcatctttctgtacctcctccctttggtgacctgaagtcactgtgacagttctccaggaaggaggagcttcctacttttgagtttctctgtggaaataaaacatgaatcttgtttcccta

SEQ ID NO: 126515 - DNA, 567 bp, Homo sapiens
  Payload ID: 4799
  Gene Symbol: DMKN
  Gene Name: dermokine
  ENST ID: ENST00000461300
  CDS Start-End: 349-450
ccccggcctgcggtgggcagcagctcaggttctccaaatcattgcgtagttccgaataccctcggccacacctggccttctccatgctcggaataacttcctgcagcgaccaacaggctaaagagggggaaggtctggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126516 - DNA, 577 bp, Homo sapiens
  Payload ID: 4799
  Gene Symbol: DMKN
  Gene Name: dermokine
  ENST ID: ENST00000474928
  CDS Start-End: 359-460
ttgcgtagttccgaataccctcggccacacctggccttctccatgctcggaataacttcctgcagcgaccaacaggctaaagagggggaaggtctggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126517 - DNA, 738 bp, Homo sapiens
  Payload ID: 4799
  Gene Symbol: DMKN
  Gene Name: dermokine
  Uniprot ID: Q6E0U4
  ENST ID: ENST00000492341
  CDS Start-End: 249-620
ctgcagcgaccaacaggctaaagagggggaaggtctggaggttggaaagaggactggaatctgattggggttccaacaaatctgtaacaccgctgggaacgactgggtcccctttaggtcctttaggacagcgtttgaaatcttgctttcccctgcagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcag

SEQ ID NO: 126518 - DNA, 638 bp, Homo sapiens
  Payload ID: 4799
  Gene Symbol: DMKN
  Gene Name: dermokine
  ENST ID: ENST00000597212
  CDS Start-End: 1-459
tccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggtgagtgtcagagtgagccgacccaggccacatcctggcagtggaggcacagtcacccggggcagggccaggatcttggtatatcctcagatctcagtgggcagcgacatgaagtcaggcaatttcttgcaaccaccaccgaggccccgaaaagcactggtcgtcagggagctcctccc

SEQ ID NO: 126519 - DNA, 351 bp, Homo sapiens
  Payload ID: 4799
  Gene Symbol: DMKN
  Gene Name: dermokine
  ENST ID: ENST00000595571
  CDS Start-End: 1-111
tccggcaaccacggtgggagcggcggaggaaatggacataaacccgggatctcccgactctggctcacaaagtgggttcttctctcatcccatatctccttggttccatagaactctgagacgtctcctgggatgtttaactttgacactttctggaagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126520 - DNA, 370 bp, Homo sapiens
  Payload ID: 4799
  Gene Symbol: DMKN
  Gene Name: dermokine
  ENST ID: ENST00000470746
  CDS Start-End: 10-120
gccttctccatgctcggaataacttcctgcagcgaccaacaggctaaagagggggaagggatccagcaccggctcctcctccggcaaccacggtgggagcggcggaggaaatggacataaacccgggtgtgaaaagccagggaatgaagcccgcgggagcggggaatctgggattcagaattttaaatccaagctgggtttcatcaactgggatgccataaacaaggaccagagaagctctcgcatcccgtgacctccagacaaggagccaccagattggatgggagcccccacactccctccttaaaacaccaccctctcatcactaatctcagcccttgcccttgaaataaaccttagctgccccaca

SEQ ID NO: 126521 - DNA, 1936 bp, Homo sapiens
  Payload ID: 4800
  Gene Symbol: DHH
  Gene Name: desert hedgehog
  Uniprot ID: O43323
  ENST ID: ENST00000266991
  CDS Start-End: 308-1498
gtccggagtccgggcgttctggcagcaccagagtcctgcagcagagacgggctgggctggcactcacccacgaccccccttccctgctatgatggtttgtcagtagcaggtcctagacaccccccgcccgctcccggggcacgtgggcagagctagcagcagccaggtgcacggagccacaagagctctagggcactctgggggcagctgtgcctgctgccctctctggtgcctgtggagatgcctaactgacaggagagttagtgaggacaagaacgctcccttttggccgaggtccgctgtatccatggctctcctgaccaatctactgcccctgtgctgcttggcacttctggcgctgccagcccagagctgcgggccgggccgggggccggttggccggcgccgctatgcgcgcaagcagctcgtgccgctactctacaagcaatttgtgcccggcgtgccagagcggaccctgggcgccagtgggccagcggaggggagggtggcaaggggctccgagcgcttccgggacctcgtgcccaactacaaccccgacatcatcttcaaggatgaggagaacagtggagccgaccgcctgatgaccgagcgttgtaaggagcgggtgaacgctttggccattgccgtgatgaacatgtggcccggagtgcgcctacgagtgactgagggctgggacgaggacggccaccacgctcaggattcactccactacgaaggccgtgctttggacatcactacgtctgaccgcgaccgcaacaagtatgggttgctggcgcgcctcgcagtggaagccggcttcgactgggtctactacgagtcccgcaaccacgtccacgtgtcggtcaaagctgataactcactggcggtccgggcgggcggctgctttccgggaaatgcaactgtgcgcctgtggagcggcgagcggaaagggctgcgggaactgcaccgcggagactgggttttggcggccgatgcgtcaggccgggtggtgcccacgccggtgctgctcttcctggaccgggacttgcagcgccgggcttcatttgtggctgtggagaccgagtggcctccacgcaaactgttgctcacgccctggcacctggtgtttgccgctcgagggccggcgcccgcgccaggcgactttgcaccggtgttcgcgcgccggctacgcgctggggactcggtgctggcgcccggcggggatgcgcttcggccagcgcgcgtggcccgtgtggcgcgggaggaagccgtgggcgtgttcgcgccgctcaccgcgcacgggacgctgctggtgaacgatgtcctggcctcttgctacgcggttctggagagtcaccagtgggcgcaccgcgcttttgcccccttgagactgctgcacgcgctaggggcgctgctccccggcggggccgtccagccgactggcatgcattggtactctcggctcctctaccgcttagcggaggagctactgggctgagcgtcccaggcatagaaacctcgaagcgcccgaggaaacgagggcctgctggctgagatatggggctgtgggcagcagacgatgccgactggaagggagggagagggagggggagggagaaaatggggctatgcctggcttaggggcaacctcgtactgagaggaggtgataccgggtcctaggtaggtagggctgatggtgcgcactccttaaagaggactatttagcctctcccccagtgcttcagccccacccgataattttattttatttcttatttataaattgtaatataatgattcccttgcccagcttgccaaggtgaggggctggggcatggcattaacactgtctgacacagccagccagtctgacatctgacgttttcctgcaaggtgggctaataaagggaaggctttcaggagcttactggaaaa

SEQ ID NO: 126522 - DNA, 2248 bp, Homo sapiens
  Payload ID: 4801
  Gene Symbol: DES
  Gene Name: desmin
  Uniprot ID: P17661
  ENST ID: ENST00000373960
  CDS Start-End: 87-1499
gtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccactcggctccccgctgagttcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaagccaa

SEQ ID NO: 126523 - DNA, 4271 bp, Homo sapiens
  Payload ID: 4802
  Gene Symbol: DSC1
  Gene Name: desmocollin 1
  Uniprot ID: Q08554
  ENST ID: ENST00000257197
  CDS Start-End: 263-2785
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatatgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttacgaatgaaggtacaggatcaggatttgccaaacactcctcactcaaaggctgtatacaaaatcctacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagaatccattagaggacacactctgattaaaaattaaacagtaaaagaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctagggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaa

SEQ ID NO: 126524 - DNA, 4225 bp, Homo sapiens
  Payload ID: 4802
  Gene Symbol: DSC1
  Gene Name: desmocollin 1
  Uniprot ID: Q08554
  ENST ID: ENST00000257198
  CDS Start-End: 263-2947
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggttttaacattactttgcgatgcttgtcagaaagtttatcttcgagttccttctcatcttcaggctgaaacacttgtaggcaaagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaagtctcctaagaagagacataccaaagacacagccctcaagcgcagcaagagacgatgggctcctattccagcttcattgatggagaactcgttgggtccatttccacaacacgttcagcagatccaatctgatgctgcacagaattacaccatcttttattccataagtgggccaggcgtggacaaagaacccttcaatttgttttacatagagaaagacactggggatatcttttgtacaaggagcattgaccgtgagaaatatgaacagtttgcgttatatggctatgcaacaactgcagatggctatgcaccagaatatccactccctttgatcatcaaaattgaagatgataatgataacgccccatattttgaacacagagtgactatctttactgtgcctgaaaattgccgatccggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaaaaatgtgatacttaccagttaataatggaagtgcgagacatgggtggtcagcctttcggtttatttaatacaggaacaattactatttcacttgaggatgaaaatgacaatccaccatctttcacagaaacttcttatgttacagaagtagaagaaaacagaattgacgtggagattttacgaatgaaggtacaggatcaggatttgccaaacactcctcactcaaaggctgtatacaaaatcctacaaggaaatgaaaatggaaacttcataattagcacagatccaaatacaaatgaaggagtgctgtgtgttgtcaagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtattctgtttacatgtttctgtgtcactgctaagagaacagtcaagaaatgttttccagaagacatagcccagcaaaatttaattgtatcaaatactgaaggacctggagaagaagtaacggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaaaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctagggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaa

SEQ ID NO: 126525 - DNA, 4826 bp, Homo sapiens
  Payload ID: 4803
  Gene Symbol: DSC2
  Gene Name: desmocollin 2
  Uniprot ID: Q02487
  ENST ID: ENST00000251081
  CDS Start-End: 34-2577
cgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaagt

SEQ ID NO: 126526 - DNA, 12325 bp, Homo sapiens
  Payload ID: 4803
  Gene Symbol: DSC2
  Gene Name: desmocollin 2
  Uniprot ID: Q02487
  ENST ID: ENST00000280904
  CDS Start-End: 445-3150
ggcttctgctgggcagggccggctgttaatctcgcctggcggagcggacaccggggcgtggtgggggagatgggccttataggtggcgtccgctggtgagaaacaccttgcgcaggtaaaagggtggcggcgagagggagttcccacccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaagtcacatgtacaattcatttcatgttaacaaaaggtcaattaagacaataagatactgaaaagatttttcttttcactgtagaacatgtctcttcataatgatcacctgatgactgggtcttgtatgttcagtttttcagaatacgtagtgcaaagattgctgaggcattcgtatgggattgcctggtttgaaacactgtgaaactgtaaggttcaaattggatgaaaagcagaacatctgcttcttaaaatgggcactaattctaacaccctatgaaaattatgtgtattttagattctccctgtcaatcccttccttggcttcttccctagctgtccagctagacattagcagtcacttgcctgggaggtcatggctgtttggcagtcgtcatagtaaccccaagtgctaagacttccaagtaagagtgtcttgatgcaaattccggctctatccttactagctgtgggatttgagaagtcacttaagctttctgtgcttagtttccttacttataggacctgtactgaggagggtagaggagtctacttgacagggctttgtcagagttaattcatgaaaagagttggcatagagttagcactcaatcatgtaccttagccactgctattgttctatgagcagagaacgcctgagttgggaacaatttagcttcagtctccactctgctttactgctgacatcttgccatgatgctcttattcacctttcccagaagcccgaccagtatttcaccagtgatggcctttgggaatttcatggctcatagtagcttccaggtctctcatttgtggtattcagcaagttacatcttattcatccctagccagaagtcagtgtgataaatcttgatgcttaactgaaaaggcaggtaaaattctcgaggaggcaaaatcataaagagtttcccgaagaaatggctggtgcttcttcagcaaatgaaaagcagcaagatcttctgttccatgcagtgtgtgtctgggggctcctggtaatcattactttttctttattcccatcttaagactgtttttatcttggatcccaattctgttttgccaaatctgactttgactacgggcttcccttttgtctccatctccattcctggactccagattgaagtcttgacaactgactttgctctgatcagcccctttagtatcatctccaaaataaaatgctttcccttctttgtgcctagaatcatcttgtttttcacctccttaaatattcaaagccctaagaagttacctgatatccgtataaacctacagctcttatatcagctcccctgcgagccccctgttaacctagcacttcaaactcatgcaaaaagacaaacacatactaccacatcaaatcaggttctcctgagttatttacacaatggtgcccttcttccacttacttaggcttgaaacagagaatccttgattcctctctcttctttccatagcatcctctattttttgccaaaaactgccaaacttttgagaattgtagacacaatttcattcattaaatactttgtttgtactgtagtcatttgatgccttcccagtgcagtcatatgtagccttttaaaacagagactagaaggactgtgcttctatgagaaagtgcaagatgaatcagccactctccccacccacacacttgaatgcaagtcaagacacggtggatgtaaggagtgggctaatgcctgtaaaacacatcacacaatgcctggcacatagtaagtgcataatgcatgtttttaaaaagcttcagatgatgtgaaagaacttcaggacactagtgagtgaacttctgcttctgctactcccaatccaagcattcatgaggttgaggtgtaccctatgtcagctgttcccactcttcacttcattcctgatcaatattcccccccgccagtaccccagattaaatcttcagcatcactcagctccaatggtgtttatgcttccaatttcttccctcttctcttttttcaagggccatcaaagagcagatatgatcatgccattctgcctaagagctttctatagggttttagaggataaattctaaacacaaaatcacttttaaatacagatgcttcttgacttatgatggggttacatcctgataaacccatggtaaattgaaaatattacaaatcaaaacagcattttccatttaccatatgttcaacttaaaataagcttattgggatgtagtctcataagtgtaggagaatgctgaatgcatatttctttgacaccatcataaagttgaaatatcagatcgagccatcttaagttgaggaccttctgtactaatttccccaatctccttgtatccttcatttttcaatttgtgccttgctcatgattagttctctttttacaatgtctttactcattgtctctttctttgtaaaaatattactttttgaggatctagtaaaaatactaccgcctagacatttgtgtgtctagagcacatggctgtaaagttttcatctacaggtttgtgtgtgtgtttcttttctttcatgtaggacactaaggaccaagaaaggtgttcacaattgcatgcctatacaactctggccattaatttttttttttttttttttgagacggaatctcactctgtcacctaggctggagtgcagtggcatgatcatggctcactgcaacctctgcctcccaggttcaagcaattcttctgcctcagcctcctgagtagctgggattacaggcacctaccaccacgcctggttaatttttgtatttttagcagagaaagggtttcaccatgttggccaggctggtcttgaactcctgacctcaagtgatctgtcagcacttggcctcccaaagtgctgggattacaggcataagccactgtgcctggccaaattttgattcatcaaattatattgcccaggtcataaaggaaaaaagagaaataataaaagttaggttttttattctcagcacatactaattttctgtggcataaattttacatgatagacatggtgtatgttagattctgcactgaattgtttttcctcagaagacattgaatgactagaacaattgtttgcattcacagcttaatacaggaaagtgaagtgttgagattttggaatcccttctcccttgggatagtgagaggggcagacagaaggggtagtgtctgaatattgtggttcaggccagctcaaatcctaccaccaataattgcacgaacctacttgtagccaccaataattgccccatattgaaatgtaacccccaagggttctcctctgtcttcttgaccactgtatgcctaacatgtagagcagtagacactgaatatatttggtgtgtgatgaataaatggatgaatgaataaatgcacatgtgtgttaggtacctggctaagatcagactgcatattgcctaaagaattctttttctcaacttgaaaatttttagccaatgtgaaaattatgtttgcgactgtcacttcatcattgccaggttcaaacactgcagtgaattttttttttttaaccaaaaggccactctctaaccacctgaggaaaagcaactaaaaaccacttatgtttagaaattcaagaaatgattcttatgagtttgccaaaattcccattagttatttataaaatgttgtaagtcaggccttgcttcaaaaaatatcttgagaaaccacaaagcaaagaaagtggcatacatctacgagctttttccatgttaggctgggagaacattctgtaacaggaaaccaccgtgctcatgtgtgccctgagagaagaaaatcttcacacaagaagtagagaatagggaaagaaatgcatagcaatgagcctcagaggcaatgcctatattgtgctgtgaactgataatgtcacttggaagataacacgtaagaggtagttcccagccctgctcttctcacgtaggacatgtaggacagacctatgtgttttgctttctggggagaggggatcagttgtatgaccccctttattatttcctcttcaccagttctggttttctaggtttgaggactgaaatcttgagaagtaggatctgatctttcttccaagaagctcttctctccccacctgtccttgtgttctttatcccatcaatagctaagaagcagaacctattacttttgcttaaatgttttaaattaagcaaatagatacattatgaggctgcattttaaactttagatatttcaaataagacatgcaatatagagtcttaaggtaaaacaaaagagcataatgctaaaaaacaggcaacaaaaagaagctagagctttgaaatagctagtcaggtaaacagagcactttaatttaaaagaacacaccctaaatcttgttttatagaggaattttactgtgtcatggatttggagcatattcttctcaagccatttggtatatcctaaattctaggtatacgtgagattaaagaagagatactcactgatgtgcctccgtatggagtgatagttggtgcatgggaaatggcaagggctgttttgtttcattctctcttccctttgtgactgtacctttgtatccctacagaaaatctgggcatagctgagaggttagaattgtggagtttctgctagccacatcttttctgtttacttattttgttaggattcaagggagaggacagagcagaacactcactgcttttcagttaacaaatatgaaggcaaacttgctgatatattcgcttgtataatttttagagtgtgtttcactgaccatcagcatcagaatcaccctggtgttgctgaaaatagagatccctcatgaatcagtcacaggagtaacaggctagtaggggaaaagtatagaagccttcacttttcaatacattttctaggtcattttttcttactctaaagtttgacaatcgttagggttttagtaactgggtttattgattatttggtggtttatgaaacttaagtatttaaaatttgccttttcatataaaacatattaagcaaaatgctagaaatgtaccaaagagttgaaacacattgatgagtaaaatttcacaatgtctgcaaattaagcatttcagaatgtacattgttccctgtggtttctactttctacatgcatgtgaacgagagaaatagtcttaaggtaggaatgcagaacaaagccacacagaaaacatttaataaaaattaacaagttttgccacataaatgctgctagtcaagaagatgtatgcaaagtaagttgcatatatttttaaaaatcagaattgccaaatctccagagataaatagaactagaaaggtcaacagcaggtggaacaagtgactgtccagaaggcagcaactgtttggcatcactgtgctgttgtgtggggacctgtgtcaggtggggtaacaggtaatgctcactgactgtggcggccaggagcttcagaggggcctgtgaatcagggatgggagatgagggtagagacgagacttttcagcttaaggagtgttcccctgggaacagggccaattggaaaactcccaggcaccaaggacatgagttaaccaatagggaatgagaggctcagaaagccagaggtgaaaggagcagagggtgtcaatatacacaagatgtgatgcagaattaccaatgaaatcaagtaaaagggatttatccaaaagaagtaagagaatagtgtaaagattctactcacatgcaaggatgtttgtctcagtggcattaaatatatgaataactgaaaataaactaaatgttccatgacagggaagtaattaaatgatgtatgatccattactgtgatacaatgtaccataattgaggacaatggaaacaatgatcacacacagacttcgcagtcagaaagacgtggatccaaatctcagctttgttcttgctgtgttaccttgggaaatcacagaaacctcaaatttctagcatatcaaataaggacaaattaggaataaattatataattcacataaagatcctagcttactgcttggctcatcagtatatcaataaccagcagctatcactattgtgatatgatgatggaatatcatgcaatcattttattttgaaaactttaattaaatgggaaaagacataaactatagtagtattttaaaactaggataggtttccaaattattataatctcacatttaaataaatatgagactatctgtaatacactaagatattgagtgataaatcctcggtaaatgaaatatttattcattgtgtgtttccatgttttcattttaccacaagcatttataatttataacattgagggaaaagttcatgtaaatgaaatacagagcaagaaaaactcacaggctttagaatttggggagcttacaggcctgtgaagaaaagccttttcatcttagctttaataaataaagttttcactgaacatattatatttacagtaaatgattaaattgaaagcaaaaagaaaatactgtatcatctcacattatcataactgagtgcattcatgtgcttttggtcttaaaattttactttaacgcacttaggatttgtcgtcagtaatttgttatgcactatctagactaagaataggtattaatttactagaattgtcaaatgaaatatttcaagcaaagtttgcataatgaatgcaagtttaaaccaattaaatgtgttcactttttagcaagctaagctgctccttatttctcctgtagtagacacaatcacagttaatctttgcacaatgcatcgcattctccatgcaacctaacagagcggtctgggatagagcctgaactttgggtcccttggggcccaacaggcaaggttcagatctgggctctaccacaaaccatctgtgtaacctgaacctccctagtcttcagtttcctcatctgctttaaaaaattgctagaacatagttctatgtaaatgttcggtgttaaaatttatttggtatctactgtatgtaagatatggcctctgctctcaaaaatatgtagtcccagaagtgatataatatgttcacggagacgtactattaaaaagtgccacaaaaaa

SEQ ID NO: 126527 - DNA, 6939 bp, Homo sapiens
  Payload ID: 4804
  Gene Symbol: DSC3
  Gene Name: desmocollin 3
  Uniprot ID: Q14574
  ENST ID: ENST00000360428
  CDS Start-End: 82-2772
tcccgcgccctgcacctcggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgctggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccccccttttttttttgagacggagtctcgctctgacgcacaggctggagtgcagtggctccgatctctgctcactgaaagctccgcctcccgggttcacgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtatccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcgatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgtagttggatatactaccgaacaatatctcatctctttttagggaaataaagtttgtgcatatatataatcccgaaacatg

SEQ ID NO: 126528 - DNA, 6978 bp, Homo sapiens
  Payload ID: 4804
  Gene Symbol: DSC3
  Gene Name: desmocollin 3
  Uniprot ID: Q14574
  ENST ID: ENST00000434452
  CDS Start-End: 156-2675
gaagttgctcccgggcaggcaagcctgagagaggccaaatacacttaaaaacaagcagcggcgagaaaagcacctcccgcgccctgcacctcggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgctggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaagaatccattagaggacacactggttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagcaagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccccccttttttttttgagacggagtctcgctctgacgcacaggctggagtgcagtggctccgatctctgctcactgaaagctccgcctcccgggttcacgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtatccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatgtggggagatgtaataaaacaatattaacttggtttcttgtttttgctgtatttagagattaaataattctaagatgatcactttgcaaaattatgcttatggctggcatggaaatagaaataattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgattgggtattaaaagtattagaaggtggttataattgcagagtattccatgaatagtacactgacacaggggttttactttgaggaccagtgtagtcaagggaaaacatgagttaaaaagaaaagcaggcgatattgcagtcttgattctgccacttacaggatagataacgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaatgagttactatacctaaagtacatagaacactgcctgcacatagtaaaagaattataagtgtgaggtagttggtaaaattatgta

SEQ ID NO: 126529 - DNA, 907 bp, Homo sapiens
  Payload ID: 4804
  Gene Symbol: DSC3
  Gene Name: desmocollin 3
  ENST ID: ENST00000584980
  CDS Start-End: 1-644
ccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaagaatccattagaggacacactggttaaaaattaaacataaaagaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttcca

SEQ ID NO: 126530 - DNA, 5045 bp, Homo sapiens
  Payload ID: 4805
  Gene Symbol: DSG1
  Gene Name: desmoglein 1
  Uniprot ID: Q02413
  ENST ID: ENST00000257192
  CDS Start-End: 213-3362
ccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagaaaaagaacagagaagaacaaacaaaactcccttggtcttggatgtaagagaatccagcagagatggactggagtttcttcagagtagttgcaatgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggcggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgccattttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctgga

SEQ ID NO: 126531 - DNA, 1857 bp, Homo sapiens
  Payload ID: 4805
  Gene Symbol: DSG1
  Gene Name: desmoglein 1
  Uniprot ID: Q02413
  ENST ID: ENST00000462981
  CDS Start-End: 310-1536
agtctttacacatgaaccaagatggccgccatcactcacagtctatgctgttttttgtgctgagaaagctaatggagaaaatgaagaggaatcagaaacacaacaaaattagatggaagtaaccagggaagattttctaagtgaagttcaaattttaaatggatttcagaatttcctaaatagtattttttttttaggaaatctgaggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctg

SEQ ID NO: 126532 - DNA, 5831 bp, Homo sapiens
  Payload ID: 4806
  Gene Symbol: DSG2
  Gene Name: desmoglein 2
  Uniprot ID: Q14126
  ENST ID: ENST00000261590
  CDS Start-End: 210-3566
attttctcgcggcggccacacctggagccgcgcctttgggttgggctgggctgggccgcgcaaccgccacgggaagacagccctcggggcggggagggagagggtggccgggccggggggaggccggggccagggaggagccgagtgcgcgctcggggcaggcggcggcgcggagcggtgcggcggcgggaggcggaggcgagggtgcgatggcgcggagcccgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaacgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgtttttgtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaccctttccccatagatttttatttctctattatattttacaaggaatataactcagtttgttagggagagtgccttaaaggcaggtgtttcttggactttgttatttaattagatctgcttgcaataaaaaaagttgtcggttatctaaaattcaaa

SEQ ID NO: 126533 - DNA, 1081 bp, Homo sapiens
  Payload ID: 4806
  Gene Symbol: DSG2
  Gene Name: desmoglein 2
  ENST ID: ENST00000585206
  CDS Start-End: 33-731
gtgcggcggcgggaggcggaggcgagggtgcgatggcgcggagcccgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaatatgttatgttgcccatctttaaactctctatcctttccagtttctcctctctttttcttttctaattttcttattttgttctgtattccttatccataggataactcttggaattactctcttttagggatgtgctgtccaatatgggccatgtgactattgagcacttaaaatgtgactggcccaaattgtaatgtgctgtatgcacgttgaatgtgtaatatatgcaccagatttgaaaaacttaatatgaaaaatgcaaaatatgaccttaatgttttttgtgatcattgcatgttaaaataatattttagatatcatagattaaataaaatatacttgtttaaaa

SEQ ID NO: 126534 - DNA, 5525 bp, Homo sapiens
  Payload ID: 4807
  Gene Symbol: DSG3
  Gene Name: desmoglein 3
  Uniprot ID: P32926
  ENST ID: ENST00000257189
  CDS Start-End: 84-3083
ttttcttagacatcaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccacctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggattaagcaggagcgctggttcttgtctccattgccttttcttatatcattgataatgatgtaagaatcacaaggggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacagctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgtttgtgctttcacctagaagggtgtggtcctgaaggaaagaggtcccctaaatatcccccaccctggtgctcctccctctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgacttaaaaattgatttgccatgtaaaatgtatctgcattttttacacaaaacttgttttaagcataaaattttaaaactgtactacttgatgtattatacattttgaaccatatgtattaaaccataaacagtataatgttgttataataaaacaggcaataaatttataaataaaagctgaa

SEQ ID NO: 126535 - DNA, 3579 bp, Homo sapiens
  Payload ID: 4808
  Gene Symbol: DSG4
  Gene Name: desmoglein 4
  Uniprot ID: Q86SJ6
  ENST ID: ENST00000308128
  CDS Start-End: 136-3258
caccacagttatcacccatgccctcctaaaagggtgtctcaaagcatatctttctgtagagcagaattcggaactgagaagacgagggctcaaattgaatctcacaggatttgcgtgcaagagaaacccaaaggaatggattggctcttcttcagaaacatttgccttttgatcattctaatggtggtgatggaagtaaacagtgaatttattgttgaggtgaaggaatttgacattgaaaatggcactacaaaatggcaaacagtcagaagacaaaagcgggagtggatcaagtttgccgcagcctgtcgagaaggagaggacaactcgaagaggaaccccattgccaaaattcgatcagactgcgaatcgaaccagaagataacataccggatttctggagtagggattgatcgaccaccatatggggtattcaccattaatcctcgcactggggaaattaacatcacttcagtggtagacagagaaataactccacttttcttgatctattgccgggctctgaattcacggggtgaagatttagaaaggcctcttgagcttagagtcaaagttatggacataaatgataacgctccagtcttttcgcaaagtgtatacacagccagcattgaagaaaatagtgatgccaatacattggtagtaaagttatgtgccacagatgcagatgaagaaaatcatctgaattctaaaattgcctacaagatcgtctctcaggagccatcaggtgcacccatgttcattctgaataggtacactggagaagtctgcaccatgtccagtttcttggacagagagcaacacagtatgtacaacctggttgtgagaggctcagatcgggatggagctgcagatggactgtcttctgagtgtgactgtagaatcaaggttttagacgtcaacgataatttccccaccttagagaaaacttcatactcagccagtattgaagagaattgtttaagttcggaactgatacgattacaagcaattgatcttgatgaagaaggcactgataactggttggctcaatatttaattctctctggaaatgatgggaattggttcgatattcaaacagatccacaaaccaatgaaggcattttgaaagttgtcaagatgctggattatgaacaagcacctaacattcagcttagtatcggagttaaaaaccaagctgattttcactactccgttgcttctcaattccaaatgcacccaacccctgtgagaattcaagttgttgatgtgagagaaggacctgcatttcatccaagtactatggcttttagtgtgcgggaaggaataaaaggaagttccttattgaattatgtgcttggcacatatacagccatagatttggacacaggaaaccctgcaacagatgtcagatatatcatagggcatgatgcaggcagctggttaaaaattgattcaagaactggtgagatacaattttctagagaatttgataagaagtcaaaatatattatcaatgggatatacacagcagagatcctggctatagatgatggctctggaaaaacagctacaggaaccatatgtattgaggttcctgatatcaatgattattgtccaaacatttttcctgaaagaagaaccatctgcattgactctccatcagtccttatctctgttaatgaacattcttatgggtctccgtttactttctgtgttgttgatgagccaccaggaatagctgacatgtgggatgtcagatcaacaaatgctacctcggcaatccttacggctaagcaggttttatctccaggattttatgaaatcccaatcctggtgaaggacagctataacagagcatgtgaattggcacaaatggtgcagttatatgcctgtgattgcgatgacaaccacatgtgcctggactctggtgccgcgggcatctacacagaggacataactggtgacacgtatgggcctgtcactgaagaccaagctggagtttcaaatgttggtcttggaccagcagggattggcatgatggttctgggcatcctgctactgattttggctccactcttgctgctcctgtgttgctgcaaacagagacagccagaaggcctgggaacaagatttgctcctgtgcctgagggcggagaaggagtgatgcagtcttggagaattgaaggggcccatcccgaggacagggatgtgtcaaatatatgtgcacccatgacagcctcaaatacccaggatcggatggattcctctgaaatctacaccaacacctatgcagccgggggcacggtggaaggaggtgtatcgggagtggagctcaacacaggtatggggacagccgttggcctcatggccgcaggggccgcaggagcctcaggggccgcaaggaagaggagctctaccatgggaaccctgcgggactacgctgacgcagacatcaacatggctttcttggacagctacttctcggagaaagcgtatgcttatgcagatgaagatgaaggtcgaccagccaatgactgcttgctcatttatgaccacgagggagtcgggtctcccgtaggctctattggttgttgcagttggattgtggatgacttagatgaaagctgcatggaaactttagatccaaaatttaggactcttgctgagatctgcttaaacacagaaattgaaccatttccttcacaccaggcttgtataccaatcagtactgacctccctttgctcggacctaattactttgttaatgaatcttcaggattgactccctcagaagttgaattccaagaagaaatggcagcatctgaacccgtggtccatggggatattattgtgactgagacttacggtaatgctgatccatgtgtgcaacccactacaattatttttgatcctcagcttgcacccaatgttgtagtaaccgaagcagtaatggcacctgtctatgatattcaagggaatatttgtgtacctgctgagttagcagattacaacaatgtaatctatgctgagagagtactggctagtcctggtgtgcctgacatgagcaatagtagcacgactgagggttgtatgggacctgtgatgagcggcaatattttagtagggccagaaattcaagtgatgcaaatgatgagtccagaccttcccataggccaaaccgttggctccacatcccccatgacatctcgacacagagtaacacgatacagtaacatacattacacccaacagtaagtgctttatggtcagtattctatgtggagaccttgcaccttgtaatcatcaatacatccaccaaaaatatataatgtaccatatatattaatagtcaacaaatactcagatattctaaggtcaatgccattatttgattataccattttgagggtgaatatggctaggcactttagataagcctttttaaaattctttctgattttaaataatgcgtcaaaaaatgtgcagaaaatgtattgcatcccttgatactgtctaacgaatagcacataactcatattgtgaatcctatgggtcttgaggcctgtagaaccaatc

SEQ ID NO: 126536 - DNA, 4526 bp, Homo sapiens
  Payload ID: 4808
  Gene Symbol: DSG4
  Gene Name: desmoglein 4
  Uniprot ID: Q86SJ6
  ENST ID: ENST00000359747
  CDS Start-End: 30-3209
ggatttgcgtgcaagagaaacccaaaggaatggattggctcttcttcagaaacatttgccttttgatcattctaatggtggtgatggaagtaaacagtgaatttattgttgaggtgaaggaatttgacattgaaaatggcactacaaaatggcaaacagtcagaagacaaaagcgggagtggatcaagtttgccgcagcctgtcgagaaggagaggacaactcgaagaggaaccccattgccaaaattcgatcagactgcgaatcgaaccagaagataacataccggatttctggagtagggattgatcgaccaccatatggggtattcaccattaatcctcgcactggggaaattaacatcacttcagtggtagacagagaaataactccacttttcttgatctattgccgggctctgaattcacggggtgaagatttagaaaggcctcttgagcttagagtcaaagttatggacataaatgataacgctccagtcttttcgcaaagtgtatacacagccagcattgaagaaaatagtgatgccaatacattggtagtaaagttatgtgccacagatgcagatgaagaaaatcatctgaattctaaaattgcctacaagatcgtctctcaggagccatcaggtgcacccatgttcattctgaataggtacactggagaagtctgcaccatgtccagtttcttggacagagagcaacacagtatgtacaacctggttgtgagaggctcagatcgggatggagctgcagatggactgtcttctgagtgtgactgtagaatcaaggttttagacgtcaacgataatttccccaccttagagaaaacttcatactcagccagtattgaagagaattgtttaagttcggaactgatacgattacaagcaattgatcttgatgaagaaggcactgataactggttggctcaatatttaattctctctggaaatgatgggaattggttcgatattcaaacagatccacaaaccaatgaaggcattttgaaagttgtcaagatgctggattatgaacaagcacctaacattcagcttagtatcggagttaaaaaccaagctgattttcactactccgttgcttctcaattccaaatgcacccaacccctgtgagaattcaagttgttgatgtgagagaaggacctgcatttcatccaagtactatggcttttagtgtgcgggaaggaataaaaggaagttccttattgaattatgtgcttggcacatatacagccatagatttggacacaggaaaccctgcaacagatgtcagatatatcatagggcatgatgcaggcagctggttaaaaattgattcaagaactggtgagatacaattttctagagaatttgataagaagtcaaaatatattatcaatgggatatacacagcagagatcctggctatagatgatggctctggaaaaacagctacaggaaccatatgtattgaggttcctgatatcaatgattattgtccaaacatttttcctgaaagaagaaccatctgcattgactctccatcagtccttatctctgttaatgaacattcttatgggtctccgtttactttctgtgttgttgatgagccaccaggaatagctgacatgtgggatgtcagatcaacaaatgctacctcggcaatccttacggctaagcaggttttatctccaggattttatgaaatcccaatcctggtgaaggacagctataacagagcatgtgaattggcacaaatggtgcagttatatgcctgtgattgcgatgacaaccacatgtgcctggactctggtgccgcgggcatctacacagaggacataactggtgacacgtatgggcctgtcactgaagaccaagctggagtttcaaatgttggtcttggaccagcagggattggcatgatggttctgggcatcctgctactgattttggctccactcttgctgctcctgtgttgctgcaaacagagacagccagaaggcctgggaacaagatttgctcctgtgcctgagggcggagaaggagtgatgcagtcttggagaattgaaggggcccatcccgaggacaggctttttagcgcctacgccttgccgggtggtggtggcaccgcagacggcggcggcagcgttttaggcagatgcgcgctgcaggcaactccagcgctgttaaaccaacatcctcccttttcagaaatctacaccaacacctatgcagccgggggcacggtggaaggaggtgtatcgggagtggagctcaacacaggtatggggacagccgttggcctcatggccgcaggggccgcaggagcctcaggggccgcaaggaagaggagctctaccatgggaaccctgcgggactacgctgacgcagacatcaacatggctttcttggacagctacttctcggagaaagcgtatgcttatgcagatgaagatgaaggtcgaccagccaatgactgcttgctcatttatgaccacgagggagtcgggtctcccgtaggctctattggttgttgcagttggattgtggatgacttagatgaaagctgcatggaaactttagatccaaaatttaggactcttgctgagatctgcttaaacacagaaattgaaccatttccttcacaccaggcttgtataccaatcagtactgacctccctttgctcggacctaattactttgttaatgaatcttcaggattgactccctcagaagttgaattccaagaagaaatggcagcatctgaacccgtggtccatggggatattattgtgactgagacttacggtaatgctgatccatgtgtgcaacccactacaattatttttgatcctcagcttgcacccaatgttgtagtaaccgaagcagtaatggcacctgtctatgatattcaagggaatatttgtgtacctgctgagttagcagattacaacaatgtaatctatgctgagagagtactggctagtcctggtgtgcctgacatgagcaatagtagcacgactgagggttgtatgggacctgtgatgagcggcaatattttagtagggccagaaattcaagtgatgcaaatgatgagtccagaccttcccataggccaaaccgttggctccacatcccccatgacatctcgacacagagtaacacgatacagtaacatacattacacccaacagtaagtgctttatggtcagtattctatgtggagaccttgcaccttgtaatcatcaatacatccaccaaaaatatataatgtaccatatatattaatagtcaacaaatactcagatattctaaggtcaatgccattatttgattataccattttgagggtgaatatggctaggcactttagataagcctttttaaaattctttctgattttaaataatgcgtcaaaaaatgtgcagaaaatgtattgcatcccttgatactgtctaacgaatagcacataactcatattgtgaatcctatgggtcttgaggcctgtagaaccaatcttgtaaaccaagatgccttgttcttggaagttacaaaagaagccctgtctacatccaccagccatatttttcgttagggaaatatttatattaaaatttttaattgaaaagttgaatgaaatgtacattctgaaaggaaattgaaaaggaacgtagagtatctgtcaatatctttagatatctgaagtcatttgtctcttcaaaagatttttcaatattatgcgctattaagcaataggagatgcttaatataataagaaaagagtttgccaactgaaagcatggctggaaatggttcatcaaagaaaaatatatatttttattgaactttattgatttatatgattaactgtaaattaatctagaatagcaaaaaaaaatgacaatcctaaagtagaaagagttattggggaaatattagagttttccccacttacagggaattttttccctactgttgccaattatgtcagaaaaatacatgaaatatggcttaaccaatttcattgacctgaatcgtagagctttcaattggcaaccagatattctccaaaagcactctgtagttattcatatattctacaatatttacttagaagcaactaggtgttgggtgctagtcttggctctgtgaatatacaggtaaagaagacagacatggtttctgccttcatagagcttctattcatttctagacttaaaataaaactctgggatatggctttaagttcctaacaacaataattaaccaactacttaagtccattaccaagttgtgtttctctttgcaacactactgtttatgttgaataaataaaatggaaacacattgcttacttttcgtaggcataaagctgacttgagaaaaagaatctctagccaggtaattttacttaattctgtaaaatatgtatacagtagcagcaataatgtgactgagataatgtaaatgaaataaacttattttcaaggcttaatccttttgaaaggaaataa

SEQ ID NO: 126537 - DNA, 9796 bp, Homo sapiens
  Payload ID: 4809
  Gene Symbol: DSP
  Gene Name: desmoplakin
  Uniprot ID: P15924
  ENST ID: ENST00000379802
  CDS Start-End: 342-8957
aagaaaccggccaggtgtggcctaggcgcccagtgccagcggggaggagactcgctccgccgccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaagtgtttgtgttttaatttaatatgtttataagcatgtataaacatttagcatatttttatcataggtctaaaaatatttgtttactaaatacctgtgaagaaataccattaaaaaactatttggttctgaattcttactagaa

SEQ ID NO: 126538 - DNA, 7812 bp, Homo sapiens
  Payload ID: 4809
  Gene Symbol: DSP
  Gene Name: desmoplakin
  Uniprot ID: P15924
  ENST ID: ENST00000418664
  CDS Start-End: 300-7118
ggaggagactcgctccgccgccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 126539 - DNA, 3617 bp, Homo sapiens
  Payload ID: 4810
  Gene Symbol: DSTN
  Gene Name: destrin (actin depolymerizing factor)
  Uniprot ID: P60981
  ENST ID: ENST00000246069
  CDS Start-End: 347-844
ttctagcctcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagccgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgacttacctctcgtgtaattttcatgtgtgaattgggaatacaggattttgccttccatatggggtaaggcattgaggtttgggtatttccaataattaagagttaaggttggctgagtgtggtggctcactcctgtaatcccagcattttgggaggccgaggcaagaggatagtttgaggccaggagtttgacaatcagcgtgggcaacatagtgggatctcatctactaaaaataaacaaaattagccgggtgtggtggtgcacgtcagtagtcccagctactttggatgctgaggtgggaggatcacttgagcccaggaggtgagctgagatcgtgccactgtactccagcctggatgacagagcaagaccttgtctcaaaaaaaaaaaaaaaagtcacaactccctctggtgaataagaaagttggtgtaaaagttgggaacgttttcaatgtttattacactataagtgtaataaatattatacaaaattataaattcacatttaaaatttagaaaatagagaaaagggaaattatacattgtcctaccacatgccatcacatggttagcattttgatacacagctgtgcattattacatgtcaaagactgcatatactatggtggtcccatacaattataatgtattttctactgtaattagatacacaaataccattgtgttacagttgccgacagtattcagtatagtaacgtgctgtccaggtttgtggtctaggagtaataggctctaccatacagcctaggtgtgtagtaggctatgccactaggtttaagtgcagtctagggtggggaacattttaatgttgatccacatgccaggtgtttgtgagacaagattatgctttaatcaaaatattttggaattgtctagaaaatagtgctggctgcttgtcattcatcctgaattgcttgtttctttactttgtagcaatgcttttagtgtgggttttgttttttgagacagggtctcactctttcccccaggctagagtgcagtggtgcaatcataactcactgcatccttgaactcttgggctccagcaagcctcctgccttggcctcctaaagtgctgtgattacaggtgtgagccactgtgtcctgctagtgattgtgattaacaggcctccagggaagtgccataagcccaagactgccgtactcaaaagtcagccatgtaggtaaagcaagatatttggtcaaggagttttagaaggagatttttcctgtggtgttggcttaagtgtggcactgttgtgcgtgtgtgaggtgtcttctgtgggaaggatttcaaacagtacaaagggatgtgatgtaagcatccagaactcactccagaaattgaataaaatgctagtagttagtctctaggggaacttttgagaaagtctcagtggattcctgaggcccaagaattgtgctaacaagcactcaaggcgattctggtacataattagggttcagacctcagctgattggtctactgttggtcaggaacaaaactgcaagtatactctgtttccagaaaatacgtttacctcttcacaaatgctaacacactgcaaaaatatgtttgtggaaagctgacttagtctcatctagcggttactctcttgccctgacaaagcagcaaataaagccattgctaacaattcaa

SEQ ID NO: 126540 - DNA, 795 bp, Homo sapiens
  Payload ID: 4810
  Gene Symbol: DSTN
  Gene Name: destrin (actin depolymerizing factor)
  ENST ID: ENST00000449141
  CDS Start-End: 120-527
cgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggaaagtgcacccactcctgagctggtcagttgtatttgacttgccactgggtgattgggatcctgatgagatggcctggccagacttcagccaggagaaaatgcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatattt

SEQ ID NO: 126541 - DNA, 1853 bp, Homo sapiens
  Payload ID: 4810
  Gene Symbol: DSTN
  Gene Name: destrin (actin depolymerizing factor)
  Uniprot ID: P60981
  ENST ID: ENST00000474024
  CDS Start-End: 311-757
ggtaagctcgcgccgccgcgtcagctcagcgctgggtctctcggtcccgcagccgtgaggaggacggtctgcatactcgctgcccgccggctccctcccccgcgtccctgcgaccgccgcggcgaagatgattttcagttcacccactagaggcaaagacgtaagagagctaccagcgtattgagaggagatacacaggcactacgagaatggagtttagaagaaggtcagagccctgggcagtgttgggccaggctttagggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgactta

SEQ ID NO: 126542 - DNA, 3833 bp, Homo sapiens
  Payload ID: 4811
  Gene Symbol: DESI1
  Gene Name: desumoylating isopeptidase 1
  Uniprot ID: Q6ICB0
  ENST ID: ENST00000263256
  CDS Start-End: 258-764
caaaagtgcatccctgcccccgccccctcttccgtgtgggccctccctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccaggctggtgtgcagtggcatgatctcggctcacagaaacctctgcctcccgggttcaagtggttctcctgcctcagcctcctgagtagctgggattacaggtgcgtgccaccacgccaggctaatttttgtattttcagtagagacagggttttgccatgttggccaggctggtctggaactcctgacctcgggtgatccacctcccttggcctcccaaagtgctgggattacaggcgtgagccaccgctgcctggccagaaaatacctttgatatggaaagaataatgatgtgaggcctggcgcggtggctcacgcctgtaatcccagcactttgggaggccgaggcaggcagatcacttgaggtcaggacttcaagaccagcctggccaacatggtgaaaccccgtctctactaaaaatacaaaattagccgggcatggtggcgcatgcctgtagtcccagctactcgggaggctgaggcaggagaatcgcttgaacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctgca

SEQ ID NO: 126543 - DNA, 859 bp, Homo sapiens
  Payload ID: 4812
  Gene Symbol: DESI2
  Gene Name: desumoylating isopeptidase 2
  Uniprot ID: Q9BSY9
  ENST ID: ENST00000263831
  CDS Start-End: 212-697
caacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaa

SEQ ID NO: 126544 - DNA, 4208 bp, Homo sapiens
  Payload ID: 4812
  Gene Symbol: DESI2
  Gene Name: desumoylating isopeptidase 2
  Uniprot ID: Q9BSY9
  ENST ID: ENST00000302550
  CDS Start-End: 380-964
attttaggtcccgaggtgcgccggccgagaaccagagcgcaggcgggctcagtcctggcgccgggccggccccgcccccggggcgcctggcgcccgccccttgctcaagccccgcctttccccacgtgtctgccgcctaggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatgtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgatatagaaaaaattgtagaagaactgggaaaagaatacaaaggcaatgcttatcatttaatgcataaaaactgcaatcatttttcttcagctttatcagagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaa

SEQ ID NO: 126545 - DNA, 486 bp, Homo sapiens
  Payload ID: 4812
  Gene Symbol: DESI2
  Gene Name: desumoylating isopeptidase 2
  ENST ID: ENST00000418162
  CDS Start-End: 183-486
agctcctctgcttctgccgaactgtccgtctctctccatggctacgtcttcagaaactcccaagcccctctaagtccagaaggtcacagctttcgggtgcctgtgctagaatctcttcaaaggtgaacaggagccaacacaccctttccttgtgtgttaaaggcaacctcgttaaaatatgaatgaggctaacatttctcaagaaaatagcccagctgaattatttagagatcctggtggtgctcctttcctacactctgaagaccactttccagtattggatgaacgaatatacctcatccattggaattggagtttttcattcaggaattgaagtctatggcagagaatttgcttatggtggccatccttaccccttttctggaatatttgaaatttccccaggaaatgcttctgaactaggagaaacatttaaatttaaagaagctgttgttttagggagcacggacttcctagaagatgata

SEQ ID NO: 126546 - DNA, 4078 bp, Homo sapiens
  Payload ID: 4813
  Gene Symbol: DDA1
  Gene Name: DET1 and DDB1 associated 1
  Uniprot ID: Q9BW61
  ENST ID: ENST00000359866
  CDS Start-End: 125-433
ggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtgtaagcaccccgcccgcccgcctccctgccggcccatccacaccctgcgtccacaccacttccaacctcataggagccgatgtatttattttccttgagtttttatttatgctgtaacctgtatcaagcgttggttaaaggggacatcagacccagtagtgtgatgttggtagatgctttttaaaaaaaacaacattgtccccccgacccccgccttccatcgggccagttccccgattcctgcccccagttctccagagaaccagagtgtgtctgtgagagtctctagcgggggctttactgtggccgggcgacaggggcgggcccggggtggcctgacctaccaggacagccgagtggccttctcccccccaacaccggtccaggccattgagactcggtcttgtcccacgcttcgcccggaactttcccatgcccaggcctcactcagcgtgcacgcacgttggggagaagtcggcccttgggatctttctcttgagtcattttatttttatcatggactagtgcgtgctccgtgtccaccccaataaaagggtctttcctacttgacctcgcgtctttgctccacacaccttggctgcagaggacggagcccctgggagtcatccctgttgtcaccaagaggagtgagaagggccccccacgccaggggccccaggaccggctggattctctcgtgggcttgctgaggccaccatgttcaaggccaagacctgcctggaccatcccctctgcctctcctgtcaaggtgaccccaaggacaggtcattcctgagagacggtccatggtgccaaggatggagcggggtcagccccctgcctgggataccgccaagcagggcagcgcacctgtcagacaccgcagagatggccggcctcatccgggggcctggggtctctggcctctgctgctcccctgaggcatggtgacagtacagacggcatctggccggtcttgctgtcctaggtggtggcctcacccttgctgggtcatagaggagctgtacagaaggttggcacctggcagttggcatgtgccatggccgctcatggggacccctcttccgccagctgggctgggtttggggctgagcttgggtatgtaggggtgttcgggctctgggcagaaggtttgtggccctgaccactgagcctggggctgggggaacaccgcttctccccttattgcccccactggtggtggtggggatctcagttttcttttgttttgttttgtttgtttgtttgagttggggtcttgtactctttcccaggctggagtgcagtggcgtaatcacagctcactgcagcctcgacctcaagccttcctcccacctcagccttccaagccgctgggaccacaggcacccaccaccatgcctggctaatttttttttttttttgagatggagtctcgctgtgtctcccaggctggagtgcagtggcaagatctcagctcactacaacctctgcctcccaggttcaagtgattctcctacctcagcctcctgagtagctgggattacacgcgtgcgcccctacacccagctaatttttctatttttagtggagacggcgttttgtcatgttggccaggctggtctcgaactcctgacctcaggtgcttcgcctgcctcggcctcccaaagtgctgtgaccgcacctggctgcctggctaatattttaaaaattttttgtagagacagggtttcaccatgttgcccaggctggtctcaaactcctgggctcaagtcatccaccttcctcagcctcccaaagtgctggggttacagacgtgaaccaccgtgcctggcagaggtctctgttttgagagctgagtctgagggcgttgggatggtgtagggttgggccacagagctagcagacactccgggctatggagggtccgcctgccccagattccactgtggagggccctgcctgtgtcagaccctcgggcctaggcggcccatctctcccaaggacggagagtgccagggtgggctcccgtcctacacaaggagtggctgaccaggcccaggcacagcacagccaccctgctgtacctcccagctcccggcagtgtctacaccacagtgatggtgctacaggggccatgtggtcacaggacaggtggtcaggaaatgcacacttgactgcggtcgatggtgccgggtccggctgaatgccctggaggctcccaggccagctggggagtcccagtccccagggttggtgtgacctgggcaggcctgcggtgtccatctgtgaatgactgagatggtgggacttcagcttccaaggccaggggccagagtgggagcagggggcactcccgcctttcccctcggcctgtctagacctctctggctcccagtttctgctttgagtggctgggggctgtctcctgcctgtgctgtctgcccgtcgctctgcagggctgctgggcgggcacctccttcccctcccctacctcagctccctcctttggggtctgagggctgtgccccagcttgcctccctgtggcctccccctagaacccctgggtctgtcgggacatgccccacctggcacacacaccctgtgtagctcccactgcctgtgggaggacgctgggcccctgagccggcctctgtctacccctcctgcctttggggtcccctttaccccactgttcccccaaactgccttccaccttctccgcctttgcacaggctgttctcctgcctccagtgaactctgacttctccacagcctcccaaagggccccttgctcacactggcccagccctgcagcatggccatgttggtctctgagccttaagcctttggatgtggacacatttgtcctcttcctgaaaaatgtgagggtctgagaggccacgttcctgttcctgagtcatacgacagagtcccagtgacttgggtctgatgtctgtcccacagtgggacatccctgctgcatcccaatgccaccccgtgtcctggggacacccaaatgtgccattctctcagtatcacaagtcggggactgcaggaggctcaggtgccaggtgccttctgatgttcatgccacaagctcttcccactgtctctggctccccagacgatgttccaggaggcgggtgtgccagaaggggccacgtcttgcaaaccaccgcgctgtcctctttgagaaggagtcttactcaggactggggcctgtgcacacattgtcgcctcttttcagcacttagagattccttcctttgtctagtggctgaagccagggctgaagttggcctccaaatctgggccgtctcagaggcggcgcagcctggagttttccatctgtggccaagacccagtttttgggaggaggccctcatgggtcaagccagcctgtaccaggatggggggagggggttcccaacctaggccccagccacccagactcccccacccccactcccttttccactgctctgacctcgggcactgttgaaatatagtttttattgcatttctgccgttttacaaaaatatgacaaaataaattaaaaacaaataaataa

SEQ ID NO: 126547 - DNA, 502 bp, Homo sapiens
  Payload ID: 4813
  Gene Symbol: DDA1
  Gene Name: DET1 and DDB1 associated 1
  Uniprot ID: Q9BW61
  ENST ID: ENST00000596582
  CDS Start-End: 87-395
ctgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgtaggacggagcccctgggagtcatccctgttgtcaccaa

SEQ ID NO: 126548 - DNA, 757 bp, Homo sapiens
  Payload ID: 4813
  Gene Symbol: DDA1
  Gene Name: DET1 and DDB1 associated 1
  Uniprot ID: Q9BW61
  ENST ID: ENST00000593466
  CDS Start-End: 138-446
acagggaggtggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaagactctcaactccacaggcgcctcctgccaggtctgctcctcggtcgcccacccgcctgcccgccatgttgcgtgctccgtgtccaccccaataaaagggtctttcctacttgacctcgcgtctttgctccacacaccttggctgcagaggacggagcccctgggagtcatccctgttgtcaccaagaggagtgagaagggccccccacgccaggggccccaggaccggctggattctctcgtgggcttgctgaggccaccatgttcaaggccaagacctgcctggaccatcccctctgcctctcctgtca

SEQ ID NO: 126549 - DNA, 1380 bp, Homo sapiens
  Payload ID: 4814
  Gene Symbol: DBX1
  Gene Name: developing brain homeobox 1
  Uniprot ID: A6NMT0
  ENST ID: ENST00000524983
  CDS Start-End: 290-1321
caatcagagagtccagagcctccggcgaatgaagctcgagtggagaactttgttgaacttcattgtcagagctgtcacttttcaaagtgctttagcgggcgggccactataaaaccatcacctcgacgagaggaccacggaggactcgcagacgcccaagtgggattgttacttggagacgtttgctaagcccaagagagaggacactgtgggggcgggaggggcgggaagcgaggcgtttaccctccggccactgaaagaagggttatttcgcccgcccgcgcctaccatgatgttccccggcctcctcgcgccccccgccgggtaccctagcctcctgcggcccacgcccaccttgacgctgccccagtccttgcagtcggcattttccggccactccagcttcctggtggaggatctgatccgcatcagccgaccccccgcctacctgccccgcagcgtgcccaccgccagcatgtcgccgcccaggcagggggcccccacggccctcaccgacacgggggcctcggacctgggctccccgggtcccggcagccgacggggcggctctccgccgactgccttctcccctgccagcgagacgacgtttctgaagtttggagtgaacgccatcctctcctcggggcccagaacagaaacatccccagccttgctccagagcgtccctcccaagaccttcgcctttccctacttcgaagggtcttttcagcctttcatcagatcttcttatttcccagcttcctccagcgtggtgcccatccccgggaccttctcctggccgctggccgcgcgcgggaagcctcggcggggcatgctgcgtcgagcagtcttctccgacgtgcagcggaaggcgctggagaagatgttccagaagcagaagtacatcagcaagcccgaccgcaagaagctggcggccaagctgggcctgaaagactcgcaggtgaaaatctggttccagaaccgacgcatgaaatggcggaactccaaggagcgcgaactcctgtctagcgggggctgtcgcgagcagaccctgcccaccaagctcaatccgcacccggacctcagcgacgtgggccagaagggccctgggaacgaagaggaggaggagggcccgggcagccccagccaccgcctggcctaccacgcgtcctccgacccccagcacctgcgggacccgcggctgccagggccgctgcccccctcgcccgcgcactcgagcagtcccgggaaaccttcggacttctcagattccgaggaggaagaggagggcgaggaacaggaggaaatcaccgtgtcctagaagccgctcgcacgccagagtactatttttaagtgctttgaaatcgaagaggtggggtc

SEQ ID NO: 126550 - DNA, 2806 bp, Homo sapiens
  Payload ID: 4815
  Gene Symbol: DBX2
  Gene Name: developing brain homeobox 2
  Uniprot ID: Q6ZNG2
  ENST ID: ENST00000332700
  CDS Start-End: 173-1192
atcgttccaagtccgccgccgtcccgggtggcctttcctccctgcctggctccgcgcgctccagccctgcgggaggcggcggcgagaagctgcggctctgggtgcggtgcggggcgcccgggcgacaggcgggcgcaaggcgggcgcgcagcagaccggttggcgccgcactatgctccccagcgcggtcgcagcccacgccggtgcgtactgggacgttgtggcttcctccgcgctcctcaacctccccgctgcgcccggctttggcaacctgggcaagagtttcctgatcgagaatttgctgcgggtcgggggcgccccaacgcccaggctgcagccgcccgcgccccacgacccggcgaccgccctggccaccgcgggcgcgcagctccggcccctgcctgctagcccagttcccctaaagctgtgccccgcagccgaacaagttagccccgccggggcgccctacggaacgcggtgggcttttcaagtgctcagtccctctgcggacagtgcgaggctgccgggccgggctccgggggaccgagactgtaccttccagccttcagcgccagcaccttccaaacctttccttctgagcaccccgccattctactcggcgtgctgcggtgggtcctgtcggcgccctgcatcctccactgcttttccaagagaagagagcatgctgcctctcctgacacaggactctaattccaaagctcggaggggcattttaagaagagctgtcttttctgaggaccagagaaaggctctggagaaaatgtttcagaaacagaaatatatcagcaaaacagaccgaaagaaacttgccatcaacttgggactaaaggaatcacaggtgaaaatttggtttcagaacaggaggatgaaatggcggaattccaaagaaaaggaagtgctttccaacaggtgtatccaagaagtaggtcttcaagaggatcccctctcacggtctgctctgggtttcccttctccatgtccttcaatatgggacgtcccccaacagcactcaagtccaagatggagggagaattctccagaaccttcagaaagactaatccaggagagttcaggggcaccacccccagaagcaaattcactgcaaggtgccttatatttatgttctgaagaagaagctggaagcaagggtgtacttactggggctgtctgaatggaagcattcctccgtgttcatttaaaagaacgcttaatagtaacatctggactctaatgccagctagcttgtacctcatcagtgcttagagcctaacaactttggagcgatgtatgaactaatgctttaggaaacccactctagtgttctcttgtttggccctagactcaggcttaatttgtaagtggaatagaatctcccagcaagtatgacagaactgaaaagaaggagagcaacagctggctcggtccctgctctgagtatgtgtatatatgtgtttgtctctatgtgtgtgtatatacataaatatccattaaaatgtattagtagaaactagtttctctttaactattgcattgagtaaattcacttccttttatgtgaagaaaactaccattgacagaatgttattaactttttgaaaataatgtaaaatttggactttagtgcaaactttcataccccaaaaacatgtttttaaaaattctctattttctgacttcttttggtatccagctgtaagtgaattttaacaccttagctcagcagtcctcaacaaatgagccactgctagatacatacactgagaatatatatttaaaatgaacctaacaagcaaattagaagaatttctgtatataactattagtatccttaatctccaagtctctggaccatcgggccatcatgagggagagacccatttaactaataattattttttgatctcttctctgtaaagatgggcctagaccagggtttgcaaaataaaatgcctttaagagcctgtcaggtaaatagagggtatggcccacccagagatatttgagtcaagtaatttttcaaatactgtattggccaaacaaaatgtctatgccaagaagtttgtgacctctggctaagactaaagaaagccgtggtgtcacagttcttaaaatttttctaactggacttaaaaccacaatactaacagaatcaatgatgatttctgtttgcgcttctagttagggactcaattttccacttaggtggcatacactttatatatcaggttatttttatgtattaacaaacaccacacagatgttttgtgttttttgactaccctgaaattgtatctttctaaaattgcatttctggtaacgatttgctgagttaatccagaagtttttactccaggaccaagaagaaattatgtttcactttgaaggaaatgaaacaaaaataggaaatgatgtggttttgcattaaactcttatcaatctgtggacaagaaacactatcagaagttcattaagtggcattttgttagtgagtaagctgcataatgatggtggcttctaatttgctgaactccactagagtctgagaagttaacgtcttttgagggtttagtgtttagaaaagatatttcaggagataacggttttaatcaacagcaggaaattattttgtacgaatagaattggacttggtatgtcaacctgtgtctttaccacatgatcttttacttaaaagtcattttagaagtgtgtctcagtgcctcattgtggggaatgggagcagggatctgctgacaaaagttaaaatttaaaacctgtcttaaaatga

SEQ ID NO: 126551 - DNA, 1383 bp, Homo sapiens
  Payload ID: 4816
  Gene Symbol: DPPA2
  Gene Name: developmental pluripotency associated 2
  Uniprot ID: Q7Z7J5
  ENST ID: ENST00000478945
  CDS Start-End: 248-1144
agccctttgtttatggcctgatctagctaaggcttctagacttcaggagcttaagaatcgtccggagggctgggcgtggcggtgcaggcctgtagtcccacccactccgaaggctgcggagggaggatcaacttgagtctgggaactcagccaggaattcaagaccagcctgggcaacacagtgaggccccctacccacatcctctccgtccccgcaatctccttccatcccagggtgttgctgaaaatgtcagatgcaaatttggatagcagcaagaagaatttcttggagggggaagtagatgatgaggaaagtgtgattttgacactggtgccagttaaagatgacgcaaatatggaacaaatggaaccaagcgtttcttcaacttctgatgtcaaactggagaagcctaagaaatacaatccaggtcatctacttcaaacaaatgagcaatttacagctccacaaaaagctagatgcaaaataccagcccttcccttgccgaccattttgcctcccattaataaggtgtgtcgggacactttgcgggactggtgtcaacaactcggtttgagtactaatggcaagaaaatcgaagtttatctgaggcttcataggcatgcttaccctgaacaacggcaagatatgcctgaaatgtcacaagagaccagattacagcgatgttcgaggaaacgcaaggcagtgaccaagagagcaaggcttcagagaagttatgagatgaatgagagagcagaagagaccaatacagttgaagtgataacttcagcaccgggagccatgttggcatcatgggcaagaattgctgcaagagctgttcagcctaaggctttgaattcatgttccattcctgtttctgttgaggcctttttgatgcaagcctctggcgtcaggtggtgtgtggtccatggcagacttctctcggcagacacaaagggttgggtacgcctgcagtttcatgcaggtcaggcctgggtgcctaccactcacaggaggatgatttctctcttcttgttacctgcctgcattttcccatccccaggcatagaagataatatgttatgccccgactgtgctaagaggaataagaagatgatgaaaagattaatgacagtagagaagtagcagcaacctgtttgaatacaatgtactaaaggagggatgtactttcagatcatgtaacctattacgaaggagtggaagaggagacaatttgaatgaatcctcatgatctacaaaacaaaatcatagtgactaggactccacagtgaagatggttgactagtgacacagccccatctaaagaatccctttctgtatgtctgaaaacccattaaaataaagtcactgcaattggccttgta

SEQ ID NO: 126552 - DNA, 1079 bp, Homo sapiens
  Payload ID: 4817
  Gene Symbol: DPPA3
  Gene Name: developmental pluripotency associated 3
  Uniprot ID: Q6W0C5
  ENST ID: ENST00000345088
  CDS Start-End: 118-597
tggagctccggttttcagcctctttccgggctacctggtagcaatttgaggctctgtcatcagtttctgctacgtttcaaagatcctggagaagcctagtgttgtgtcaagacgccgatggacccatcacagtttaatccaacctacatcccagggtctccacaaatgctcaccgaagaaaattcccgggacgattcaggggcctctcaaatctcctccgagacgttgataaagaaccttagtaacttgactatcaacgctagtagcgaatctgtttcccctctatcggaagctttactccgtcgagagtctgtaggagcagcagtcctcagggaaatcgaagatgagtggctttacagcaggagaggagtaagaacattgctgtctgtgcagagagaaaagatggcaagattgagatacatgttactcggcggagttcgtacgcatgaaagaagaccaacaaacaaggagcctaagggagttaagaaggaatcaagaccattcaaatgtccctgcagtttctgcgtgtctaatggatgggatccttctgagaatgctagaatagggaatcaagacaccaagccacttcagccataaatcttattcttgcacctttttttcttggtagtaattttatatagcaggttgagaaagctactctatgctagtatagactatacaccaataattttgataatgagttctaggatgtatttttcttgtatctttttcttcctactatgatactagtaattcataagggatctgtgtaatctgaatgtatttgaataactttagctctactgtttgatttgacccaaagaagccaagatgatataagtattcccatgtgtcttagaagcccaaagtcagtgagatgaaacccaacatcaagaaattgaagcaaagttacttatggataaagaaagcattaggtagttgggctatagcataattagattttctggctttcaaaaatttggattgcaatcacagcaaactttgttatttttacagttttcagtacaaaagtgtttatatagaaacaataaagttgacatttgagtaccttttaaaaa

SEQ ID NO: 126553 - DNA, 2817 bp, Homo sapiens
  Payload ID: 4818
  Gene Symbol: DPPA4
  Gene Name: developmental pluripotency associated 4
  Uniprot ID: Q7L190
  ENST ID: ENST00000335658
  CDS Start-End: 56-970
aagtgggaggagactttgcaaatagcaatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctatcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcctgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttcttatactatgtgtattgttccttttgtttcctttttaaacttctcccctgctttatttggatgggtcaagtttctgttctgtttccttcctttctattaatttggaaatgtccttggctttacgattctgcttgtagatacttcccctgcttctaacacatttcaataaacttaaatttctctatatacaaaataaattaataattggagtctacca

SEQ ID NO: 126554 - DNA, 320 bp, Homo sapiens
  Payload ID: 4818
  Gene Symbol: DPPA4
  Gene Name: developmental pluripotency associated 4
  ENST ID: ENST00000477303
  CDS Start-End: 214-320
taagacgttgcacaggcactgaacggccatatccgagcgctctcaggtcctcttgacttgaactgggtcatttttaactgtctcggttttaagtcttttgtgaggtccaaatggacctccacagagaagtcgagggaagaggatcagcaggcttctaatcaaccaaattcaattgctttgccaggaacatcagcaaagagaaccaaagaaaaaatgtctatcaaaggcagtaaagtgctctgccctaagaaaaaggcagagcacactgacaaccccagacctcagaagaagataccaatccctccattaccttctaaact

SEQ ID NO: 126555 - DNA, 805 bp, Homo sapiens
  Payload ID: 4818
  Gene Symbol: DPPA4
  Gene Name: developmental pluripotency associated 4
  ENST ID: ENST00000495679
  CDS Start-End: 1-207
atgttgcgaggctccgcttcttctacaagtatggagaaggcaaaaggcaaggaggaacatcagcaaagagaaccaaagaaaaaatgtctatcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacag

SEQ ID NO: 126556 - DNA, 679 bp, Homo sapiens
  Payload ID: 4819
  Gene Symbol: DPPA5
  Gene Name: developmental pluripotency associated 5
  Uniprot ID: A6NC42
  ENST ID: ENST00000370370
  CDS Start-End: 71-421
cctgagcctcggccggcgtgattaggcctggtttgcgctggagagtggtcttggttgtgagggtcataagatgggaactctcccggcacgtagacatatcccgccgtgggtgaaagttcccgaagacctgaaagatccagaggtgttccaggtccagacgcggctgctgaaagccattttcggcccggacggatctcgaatcccttacatcgagcaggtgagcaaggccatgctcgagctgaaggctctggagtcttcagacctcaccgaggtcgtggtttacggctcctatttgtacaagctccggaccaagtggatgctccagtccatggctgagtggcaccgccagcgccaggagcgagggatgctcaaacttgccgaagccatgaatgccctcgaactaggcccttggatgaagtgaaccagtttccagccaatgcaatgaagccgggttgcagagattaggttgtggccagagctagagtgattccttaagcttgttttaaaatctgctccagcctaaagagttaagggaaaaccatttgttcccttaaagagttaagggaaaacccttggctctgagtcttgttgtgaatatttctttgatgattgttaataaaaagtgttttttcttttttcccatttttaaaaataacaataaagttttaaataagttgat

SEQ ID NO: 126557 - DNA, 1746 bp, Homo sapiens
  Payload ID: 4820
  Gene Symbol: DRG1
  Gene Name: developmentally regulated GTP binding protein 1
  Uniprot ID: Q9Y295
  ENST ID: ENST00000331457
  CDS Start-End: 162-1265
cagccccacgctttgcgactcgcggtgacccctacgcggaactctctcgcggtaattcgaagtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgatgtggccaagacaggtgatgctcgaattggatttgttggttttccatctgtggggaagtcaacactgcttagtaacctggcaggggtatattctgaggtggcagcctatgaattcactactctgaccactgtgcctggtgtcatcagatacaaaggtgccaagatccagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccacttgcccccagagtgagctggatgctgaaactgtgaagagcattctggctgaatacaagattcataatgccgatgtgactctacgtagtgatgctacagctgatgacctcattgatgtggtggaaggaaacagagtttatatcccctgtatctatgtgttaaataagattgaccaaatctccattgaggaattggatatcatctataaggtgcctcactgtgtacccatctctgcccatcaccgctggaattttgatgacctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatatgctctggtctggggtctctctgtgaaacacaatcctcagaaagtgggtaaagaccatacgttggaggatgaggatgtcattcaaattgtgaagaagtgaaacctttcccttttcccatctgccggacgaaccacaacagcgttccccatgatcaagcaccctaccccagttctttctggttttggcagtcactggatcaggatccaggggagggagatggaggcacccaaactggaacttcatttgtcttaccttggtgtcaccttgtatgtcgaactgcataaaagatctggtaggctggtcagctacatgcagctcatgtgtcattgtcagaatttgttttgggatgggctgaatgaggaagggtatatacggtgaagcagctacagaagggatccttgggaacttcatcttgagtgtgaaatggataaaaatatgacatgctgcatcttacttgatgtttacttatgggaaccccttccaaactagatatggctttcagtcctttcaagtagtctttcccacatgatactggagagaggaaggactttatgtaagttaattgatcactccccgcaag

SEQ ID NO: 126558 - DNA, 612 bp, Homo sapiens
  Payload ID: 4820
  Gene Symbol: DRG1
  Gene Name: developmentally regulated GTP binding protein 1
  ENST ID: ENST00000416465
  CDS Start-End: 75-266
gcctggtggcggtggcagtttgcccgcgggtgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaagctcctggatctcccaggtatcattgaaggtgccaaggatgggaaaggtagaggtcgtcaagtcattgcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccactaaacggagatttgccatgttgcccaggctggtcttgaacttttggcctcaagctgtctcctgcttcggtctcccaaagtgttgggattacagtgcccccagagtgagctggatgctgaaactgtgaagagca

SEQ ID NO: 126559 - DNA, 338 bp, Homo sapiens
  Payload ID: 4820
  Gene Symbol: DRG1
  Gene Name: developmentally regulated GTP binding protein 1
  ENST ID: ENST00000548143
  CDS Start-End: 1-169
cctattggaaaagatctgggactatctgaaactagtgagaatttacaccaaacccaaaggccagttaccagattacacatccccagtggtgcttccttactccaggaccacagtggaggatttctgcatgaagattcacaaaaatcttatcaaagaatttaaatattagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtc

SEQ ID NO: 126560 - DNA, 1964 bp, Homo sapiens
  Payload ID: 4821
  Gene Symbol: DRG2
  Gene Name: developmentally regulated GTP binding protein 2
  Uniprot ID: P55039
  ENST ID: ENST00000225729
  CDS Start-End: 139-1233
tgaatcctggagcaccaggcgcccacgagaacgctgttctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggtt

SEQ ID NO: 126561 - DNA, 1897 bp, Homo sapiens
  Payload ID: 4821
  Gene Symbol: DRG2
  Gene Name: developmentally regulated GTP binding protein 2
  ENST ID: ENST00000395726
  CDS Start-End: 100-1131
tctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaaggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaagga

SEQ ID NO: 126562 - DNA, 389 bp, Homo sapiens
  Payload ID: 4821
  Gene Symbol: DRG2
  Gene Name: developmentally regulated GTP binding protein 2
  ENST ID: ENST00000580929
  CDS Start-End: 49-389
gccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagcccaagaaaggtggtggcatctcctttaactcgacagtcacgctgacccagtgctcggaaaagctggtgcagctcatcctgcacgaatacaagatcttcaatgcagaagtgctttt

SEQ ID NO: 126563 - DNA, 795 bp, Homo sapiens
  Payload ID: 4821
  Gene Symbol: DRG2
  Gene Name: developmentally regulated GTP binding protein 2
  ENST ID: ENST00000496428
  CDS Start-End: 104-376
gttctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtggtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggtgggaggcagggcaggaaaaggccgtggccggcaggtgatcgctgtggcgcgcacggctgacgtcatcatcatgatgctggatgccaccaagggagaggtgcagaggtccgcagggtggggcatggggcaggctcacatgtctggggagggccaatgtgtccctgagctcgtactaggcggcctgtgggtgtttggctctctcacacgtgagagtagtggtaggacttgtcacagactaaacccaacaccacccagcctatggcgtcttctcctcaaggcttgtgtccagccagcacagaggtatcttgggactgggggc

SEQ ID NO: 126564 - DNA, 891 bp, Homo sapiens
  Payload ID: 4821
  Gene Symbol: DRG2
  Gene Name: developmentally regulated GTP binding protein 2
  ENST ID: ENST00000583355
  CDS Start-End: 18-503
ccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcc

SEQ ID NO: 126565 - DNA, 1838 bp, Homo sapiens
  Payload ID: 4821
  Gene Symbol: DRG2
  Gene Name: developmentally regulated GTP binding protein 2
  ENST ID: ENST00000580055
  CDS Start-End: 59-793
gaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtcccca

SEQ ID NO: 126566 - DNA, 566 bp, Homo sapiens
  Payload ID: 4821
  Gene Symbol: DRG2
  Gene Name: developmentally regulated GTP binding protein 2
  ENST ID: ENST00000577450
  CDS Start-End: 51-389
ttgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaagaaaaggccgtggccggcaggtgatcgctgtggcgcgcacggctgacgtcatcatcatgatgctggatgccaccaagggagaggtgcagaggtctctgctggagaaggagctggagtctgtgggcatccgcctcaacaagcacaagcctaacatctacttcaagcccaagaaaggtggtggcatctcctttaactcgacag

SEQ ID NO: 126567 - DNA, 2531 bp, Homo sapiens
  Payload ID: 4821
  Gene Symbol: DRG2
  Gene Name: developmentally regulated GTP binding protein 2
  ENST ID: ENST00000467099
  CDS Start-End: 57-329
ccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtggtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggtgggaggcagggcaggaaaaggccgtggccggcaggtgatcgctgtggcgcgcacggctgacgtcatcatcatgatgctggatgccaccaagggagaggtgcagaggtccgcagggtggggcatggggcaggctcacatgtctggggagggccaatgtgtccctgagctcgtactaggcggcctgtgggtgtttggctctctcacacgtgagagtagtggtaggacttgtcacagactaaacccaacaccacccagcctatggcgtcttctcctcaaggcttgtgtccagccagcacagaggtatcttgggactgggggccgaggggcttggcctggccctgcttcctgttcagaggcacaggtgcctcatcactgcccagaacctgccaggagcccagccccaggcacagaagcattgttcatccacatcctggcagaggggtacaccaggcctgcctcctcgggaccagaaggagtaccctcatgtggtcacctcgcgggggctccaccacttgcctgtgcatgccgaccgtaaaccgggccagtcccctctgggactgtggcagagtttagaagttccctgcagctctagggcattgggaaggagtgttctctgggttgctggggaagggggtggaggagagagtcagtctctgggtgggcagtgacatcctgcgtaacagggaagctgtgcatctggctctgtggacagcctgtgaggggcttaaggggtactcttcctaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggcatgaagctgaacctggactatctgctggagatgctttgggagtacttggccctgacctgcatctacaccaagaagagaggacagaggccagacttcacagacgccatcattctccggaaaggggcctcagtggagcacgtgtgccaccgcatccaccggtcactcgccagccagttcaagtacgccctggtgtggggcaccagcaccaagtacagtccgcagcgggtgggcctgacccacaccatggagcatgaggacgtcatccagatcgtgaagaagtaacggcgcctgccgggcctcccgcccacctgcctcgtctccctggggaggtggtcccactgggacacacaaacacccaaacagaaaaatacaaatacacgtaccccaggaaggggtccctcaagtctctgctatttacagaagtttcttcagtaggcagacgaagagtgtgttggggcaaaggggctcggttggaggcatttcccataagactgagccctctcatgggggttttgagtttgtagtgctgagcctgcatctgtgcctcccagccccctgcactgagggagcaagttgcccacatgcccgccagccagggcctaaagcagatggcatgctcagtgccaggctggtagctgggcctgtttgggtccctggaggctgtggctgctgtcatggcacctcactccctcagctcttgccagcttctctgacacttgggttgggggcccttccaggaggaaacccccttgggtgccccacacagggctctccatgatgggaaccagtggttagtggcttcaaaggcccagctgacaccctccacagcctaaggggtgtcctaaagtgcctccccctgtattccccctcccagggcagcccctgcccagcacaaaaccccaggaccctggctctgcacgcctggggcagggacttttgagtttaggatctgtattttctaagtccccagttctcctggctctcctttctgaaataaaggattgaaaacggt

SEQ ID NO: 126568 - DNA, 565 bp, Homo sapiens
  Payload ID: 4821
  Gene Symbol: DRG2
  Gene Name: developmentally regulated GTP binding protein 2
  ENST ID: ENST00000582419
  CDS Start-End: 60-128
agaccggaattgccggtgccgccgccaccgctgtctgtgcgcccacctctgctgctaccatggggatcttagagaagatctcggagatcgagaaggagatcgctcggacacagaagaacaaggattaagaaactgatgcacaagaagactaacttttccaaagtaaaatggccccactaatggcagggtggagttctgacacaagctctcactgccctctgagactgggcaggggaggcctctttgaagaagtgacatttgagctgcacctcaaatgatgccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttc

SEQ ID NO: 126569 - DNA, 1530 bp, Homo sapiens
  Payload ID: 4821
  Gene Symbol: DRG2
  Gene Name: developmentally regulated GTP binding protein 2
  ENST ID: ENST00000582314
  CDS Start-End: 84-356
gcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtggtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtgcagaggtccgcagggtggggcatggggcaggctcacatgtctggggagggccaatgtgtccctgagctcgtactaggcggcctgtgggtgtttggctctctcacacgtgagagtagtggtaggacttgtcacagactaaacccaacaccacccagcctatggcgtcttctcctcaaggcttgtgtccagccagcacagaggtatcttgggactgggggccgaggggcttggcctggccctgcttcctgttcagaggcacaggtgcctcatcactgcccagaacctgccaggagcccagccccaggcacagaagcattgttcatccacatcctggcagaggggtacaccaggcctgcctcctcgggaccagaaggagtaccctcatgtggtcacctcgcgggggctccaccacttgcctgtgcatgccgaccgtaaaccgggccagtcccctctgggactgtggcagagtttagaagttccctgcagctctagggcattgggaaggagtgttctctgggttgctggggaagggggtggaggagagagtcagtctctgggtgggcagtgacatcctgcgtaacagggaagctgtgcatctggctctgtggacagcctgtgaggggcttaaggggtactcttcctaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttcaatgcagaagtgcttttccgagaagactgctccccggacgagttcatcgatgtgatcgtgggcaaccgggtgtacatgccctgcctgtatgtttataacaaaatcgaccagatctccatggaagaggtggaccgcctggcccgaaaacccaacagtgtggtcatcagctgcggc

SEQ ID NO: 126570 - DNA, 550 bp, Homo sapiens
  Payload ID: 4821
  Gene Symbol: DRG2
  Gene Name: developmentally regulated GTP binding protein 2
  ENST ID: ENST00000579601
  CDS Start-End: 76-550
ctctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtttcactcttgttgcccaagctggagtacaatggcacgatctcagctcactacaacctccgcctcccagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctg

SEQ ID NO: 126571 - DNA, 683 bp, Homo sapiens
  Payload ID: 4821
  Gene Symbol: DRG2
  Gene Name: developmentally regulated GTP binding protein 2
  ENST ID: ENST00000579224
  CDS Start-End: 53-571
aattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaagctcgccaagtatcgggcccagctcctggaaccgtccaaatcggcctcgtccaaaggagagggctttgatgtcatgaagtcgggtgatgcccgtgtggcgctgattggatttccctctgtgggtaagtccacattcttgagtctgatgacctccacggccagcgaggcagcgtcctatgagttcaccactctgacgtgtattcctggggtcattgaatacaaaggtgccaacatccagctcctggaccttcctggaatcattgaaggcgcagcccaaggaaaaggccgtggccggcaggtgatcgctgtggcgcgcacggctgacgtcatcatcatgatgctggatgccaccaagggagaggtctctgctggagaaggagctggagtctgtgggcatccgcctcaacaagcacaagcctaacatctacttcaagcccaagaaaggtggtggcatctcctttaactcgacagtcacgctgacccagtgctcggaaaagctggtgcagctcatcctgcacgaatacaagatcttc

SEQ ID NO: 126572 - DNA, 2617 bp, Homo sapiens
  Payload ID: 4822
  Gene Symbol: DHX58
  Gene Name: DEXH (Asp-Glu-X-His) box polypeptide 58
  Uniprot ID: Q96C10
  ENST ID: ENST00000251642
  CDS Start-End: 224-2260
agtttcagtttccatttctgatttctgctctctgcgctgagcacagcggcaccaggctgagctaagcagggccgccttgggcaggcctacgtggtggtgcaggcgagacccaggctgggcaaggcgcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccagagaatccaaaactggagatgctggaaaagatcctgcaaaggcagttcagtagctctaacagccctcggggtatcatcttcacccgcacccgccaaagcgcacactccctcctgctctggctccagcagcagcagggcctgcagactgtggacatccgggcccagctactgattggggctgggaacagcagccagagcacccacatgacccagagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaagatccgggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcgaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaa

SEQ ID NO: 126573 - DNA, 730 bp, Homo sapiens
  Payload ID: 4822
  Gene Symbol: DHX58
  Gene Name: DEXH (Asp-Glu-X-His) box polypeptide 58
  ENST ID: ENST00000430773
  CDS Start-End: 263-730
gctctggccaggagttgggatgagtggagggcccagtgggtctgagtcccctgccattcccagaatggagctgtggccctaccaatgggaggtgatcatgcctgccagggcgctggcgcagcagcagtacttaaccggagtttgtactcacggcagttggcgatgacttttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagg

SEQ ID NO: 126574 - DNA, 1283 bp, Homo sapiens
  Payload ID: 4822
  Gene Symbol: DHX58
  Gene Name: DEXH (Asp-Glu-X-His) box polypeptide 58
  ENST ID: ENST00000413196
  CDS Start-End: 376-1283
aaagggaggtctctgtaccgactgctctggccaggagttgggatgagtggagggcccagtgggtctgagtcccctgccattcccagaatggagctgtggccctaccaatgggaggtgatcatgcctgccagggcgctggcgcagcagcagtacttaaccggagtttgtactcacggcagttggcgatgactgttagcacaaacggttcttttctcttggttctttttcctggggcggggatgggagattcctaagtcggctcagctggctccttccctcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgcctt

SEQ ID NO: 126575 - DNA, 540 bp, Homo sapiens
  Payload ID: 4822
  Gene Symbol: DHX58
  Gene Name: DEXH (Asp-Glu-X-His) box polypeptide 58
  ENST ID: ENST00000591220
  CDS Start-End: 243-540
gatttctgctctctgcgctgagcacagcggcaccaggctgagctaagcagggccgccttgggcaggcctacgtggtggtgcaggcgagacccaggctgggcaaggcgcagtttcagtttccatcttgggtctctgagctgagcagagtggcaccaggctgagttaagtgggactgccctgggcagacctacctactagagcaggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcct

SEQ ID NO: 126576 - DNA, 782 bp, Homo sapiens
  Payload ID: 4822
  Gene Symbol: DHX58
  Gene Name: DEXH (Asp-Glu-X-His) box polypeptide 58
  ENST ID: ENST00000589979
  CDS Start-End: 1-154
cgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaaggaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggatagaaaa

SEQ ID NO: 126577 - DNA, 1561 bp, Homo sapiens
  Payload ID: 4823
  Gene Symbol: DEXI
  Gene Name: Dexi homolog (mouse)
  Uniprot ID: O95424
  ENST ID: ENST00000331808
  CDS Start-End: 456-743
ccgggagggctacgcggcggccgcagccatgggtgctgggcctgcgggggcgcggggggtgcgcgaggacctgcggggcggggcgggagagaaggctgccgggaccggccctagacactgagccgcggtgggatccccaccggctctgcgaggccctgcgagcgccagggaggcgccacgagggagccgggcagccgcgggccacttcaggggggcccgcctcgccgcccgggcggtcgagagatccttgggggcacatctcggggtgcggtgacccgcccggcgcatttcgggggtcggggcgcaattgccaggggacatctggagcccggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaa

SEQ ID NO: 126578 - DNA, 1393 bp, Homo sapiens
  Payload ID: 4823
  Gene Symbol: DEXI
  Gene Name: Dexi homolog (mouse)
  Uniprot ID: O95424
  ENST ID: ENST00000469379
  CDS Start-End: 127-414
cggccctgcttctgtcgggctccagggtacccctggatggctgcgctgtgccctcgccggccgcccgggcgccgcagcggctgagttcgccgggatcgccgggccgccgcccttgccacccgctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgcccgaggacatggaccaggcgctcgtggacctcggcgtgctctccgaccccggctcgggcctttacgatgctgactcggagctcgacgtctttgatgcgtacttggagtagggtctcgactgctgttcccctcttccctacacgatccgcaacccatgccctggaccagccgcccagatcatgccgccgcagctggttgggggcaccatctggacggggatggttccccaggaggagaccctcccctgcctccgaggcctggacatggacctgtgcagagacaggcagcttctcctttgccgtctgtctccttccggccaccaggagacagccagaccccagccatgccttcattctgagataaggtagagaccctcctgccacatagcctgtcaccagcgtggaggatcagaatggctgcacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaa

SEQ ID NO: 126579 - DNA, 4514 bp, Homo sapiens
  Payload ID: 4824
  Gene Symbol: DGCR8
  Gene Name: DGCR8 microprocessor complex subunit
  Uniprot ID: Q8WYQ5
  ENST ID: ENST00000351989
  CDS Start-End: 430-2751
aggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccaga

SEQ ID NO: 126580 - DNA, 4419 bp, Homo sapiens
  Payload ID: 4824
  Gene Symbol: DGCR8
  Gene Name: DGCR8 microprocessor complex subunit
  Uniprot ID: Q8WYQ5
  ENST ID: ENST00000383024
  CDS Start-End: 430-2652
aggcccgccctccgctcgcccggcgcggcaggcgggtgccggcgaccggagagcctggacaggctttccagatggctgcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaggg

SEQ ID NO: 126581 - DNA, 4129 bp, Homo sapiens
  Payload ID: 4824
  Gene Symbol: DGCR8
  Gene Name: DGCR8 microprocessor complex subunit
  Uniprot ID: Q8WYQ5
  ENST ID: ENST00000407755
  CDS Start-End: 143-2365
gtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaa

SEQ ID NO: 126582 - DNA, 770 bp, Homo sapiens
  Payload ID: 4824
  Gene Symbol: DGCR8
  Gene Name: DGCR8 microprocessor complex subunit
  ENST ID: ENST00000457069
  CDS Start-End: 395-770
ggggctggggggcgggccccgggcccaggcgttgccgactctcgtcgctgtccgcccgggtaaagaggctcctctcccggagggcccgaagcctagcatcgccttcaggcgggaaaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccg

SEQ ID NO: 126583 - DNA, 1316 bp, Homo sapiens
  Payload ID: 4825
  Gene Symbol: DIABLO
  Gene Name: diablo, IAP-binding mitochondrial protein
  Uniprot ID: Q9NR28
  ENST ID: ENST00000267169
  CDS Start-End: 169-729
acttccggcgtgtgcgtctggcgtccgcgcgctgcacaatggcggctctgaagagttggctgtcgcgcagcgtaacttcattcttcaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggac

SEQ ID NO: 126584 - DNA, 1345 bp, Homo sapiens
  Payload ID: 4825
  Gene Symbol: DIABLO
  Gene Name: diablo, IAP-binding mitochondrial protein
  Uniprot ID: Q9NR28
  ENST ID: ENST00000353548
  CDS Start-End: 39-626
acttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtccta

SEQ ID NO: 126585 - DNA, 1336 bp, Homo sapiens
  Payload ID: 4825
  Gene Symbol: DIABLO
  Gene Name: diablo, IAP-binding mitochondrial protein
  ENST ID: ENST00000342392
  CDS Start-End: 39-179
acttccggcgtgtgcgtctggcgtccgcgcgctgcacaatggcggctctgaagagttggctgtcgcgcagcgtaacttcattcttcaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaa

SEQ ID NO: 126586 - DNA, 573 bp, Homo sapiens
  Payload ID: 4825
  Gene Symbol: DIABLO
  Gene Name: diablo, IAP-binding mitochondrial protein
  ENST ID: ENST00000446652
  CDS Start-End: 1-573
ggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactgagtgtcagttaaatccagacctgaacatagaggtggaagtttctttgcagagaga

SEQ ID NO: 126587 - DNA, 634 bp, Homo sapiens
  Payload ID: 4825
  Gene Symbol: DIABLO
  Gene Name: diablo, IAP-binding mitochondrial protein
  ENST ID: ENST00000439489
  CDS Start-End: 1-362
aggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactgaagtgttttcatcgaagttagaagaggaggatgcctgccattctccactacctgtcaacattgtcctgaaggttcttgttaatgcagtaagatcaaaatgttctacagacgaattgataaaatgtatatacccagatggtgaaatacactaactagcagcaggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcc

SEQ ID NO: 126588 - DNA, 2250 bp, Homo sapiens
  Payload ID: 4825
  Gene Symbol: DIABLO
  Gene Name: diablo, IAP-binding mitochondrial protein
  Uniprot ID: Q9NR28
  ENST ID: ENST00000443649
  CDS Start-End: 819-1538
gagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaaggccaggacctcgtgtgttcccgtccgcccctctgggacggcgccagcccggcaggccgccgaccgtcctggggctcccgcgcagcgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgggtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctgg

SEQ ID NO: 126589 - DNA, 1859 bp, Homo sapiens
  Payload ID: 4825
  Gene Symbol: DIABLO
  Gene Name: diablo, IAP-binding mitochondrial protein
  ENST ID: ENST00000413918
  CDS Start-End: 641-1141
cgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgggtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtcct

SEQ ID NO: 126590 - DNA, 560 bp, Homo sapiens
  Payload ID: 4825
  Gene Symbol: DIABLO
  Gene Name: diablo, IAP-binding mitochondrial protein
  ENST ID: ENST00000485724
  CDS Start-End: 330-560
ctttgggcaccagagcagacagaaccgcggagcttcagggtggaagattcgtggaaactttgccaagtacagacagtgtttgtgtgttcctgttgtggctaactttaagaagcggtgtttctcagaattgataagaccatggcacaaaactgtgacgattggctttggagtaaccctgtgtgcggttcctattgcacagtagagacggggtttcaccatgttggccaggatcgtctcaatctcctgacctcgtgatctgcctgcctcagcctcccaaagtgctggtattacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtac

SEQ ID NO: 126591 - DNA, 732 bp, Homo sapiens
  Payload ID: 4825
  Gene Symbol: DIABLO
  Gene Name: diablo, IAP-binding mitochondrial protein
  ENST ID: ENST00000541656
  CDS Start-End: 357-732
attcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcacc

SEQ ID NO: 126592 - DNA, 555 bp, Homo sapiens
  Payload ID: 4825
  Gene Symbol: DIABLO
  Gene Name: diablo, IAP-binding mitochondrial protein
  ENST ID: ENST00000541273
  CDS Start-End: 156-555
gcgtctggcgtccgcgcgctgcacaatggcggctctgaagagttggctgtcgcgcagcgtaacttcattcttcaggttcctgcttggctcgagtttgagtttacagcccctgcaagtaaatccaagagcctgttacagattggcggtcgtgccttatgaaatctgacttctacttccaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcgg

SEQ ID NO: 126593 - DNA, 703 bp, Homo sapiens
  Payload ID: 4825
  Gene Symbol: DIABLO
  Gene Name: diablo, IAP-binding mitochondrial protein
  ENST ID: ENST00000540535
  CDS Start-End: 318-703
attcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccg

SEQ ID NO: 126594 - DNA, 2569 bp, Homo sapiens
  Payload ID: 4825
  Gene Symbol: DIABLO
  Gene Name: diablo, IAP-binding mitochondrial protein
  Uniprot ID: Q9NR28
  ENST ID: ENST00000464942
  CDS Start-End: 1395-1955
aagctgcgtcacttccggcgtgtgcgtctggcgtccgcgcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtcaagcccggcttccttttcagttcgtccatcttctagaaacgagtccccgagaccccgggctgccttcttggggctgctccgcctcctgaccagccctcgtcagccactcgaagtccctgaggagacgtggagaggaggagggacacggcatggggggagtccgggaagggagacgagcgtctgaagacgtcctcccgagggcagaaggggccgggggagctggcgcagggctctctacctagcgctgcaggctcctgggcgattgtagcgggaccgtcacacacaactggcacccaggccaggggtccagagctaaattctgcctgcaggagcggttattgtggcatccgtttctaaaaagtttaaaggcaacattttattttattttaatttttttgagacaagatctgcctctgtcgcccaggctggagtgcagtggcgagatctcagctcactgcaacctgtgcctcccggcttcaagcgattctcagcctcagcctcccgagtagctgggattgcaggcgcccgccaccacgcccggctaatttttttttttctttttgttttgtttgagactcagtctcgctctgttgcccaggctgaagtgcagtggggcgctctcggctcactgcaacctctgcctcccaggttcaagcgattctcctgcctcagcctcccgagtagctgggattacaggagcgtgccaccactccgggctaatttttgtgttttaagtagagatggggtttcaccatgttggtcaggcagatttcgaattcctgacctcaagtgatccacccgcctcggcctttatttacttatttttttttaatagacacggggtcatgttgccagccatgttgcccaggctggtcgtgaactcctgggctcaagtgatcctcccgccttgcccttggccttccaagtgctaggattacaggcgtgagccaccaacaccctgcctgaggcaacattttaaacttggtgtatgttgaaaatttcaaaacccctcagctgtcctgcatcctcatttaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggc

SEQ ID NO: 126595 - DNA, 804 bp, Homo sapiens
  Payload ID: 4825
  Gene Symbol: DIABLO
  Gene Name: diablo, IAP-binding mitochondrial protein
  ENST ID: ENST00000474004
  CDS Start-End: 335-804
tgctggtattacaggtgtgagccaccgtaccccgccacaatttattttatatgtaaagaaataatttgctttttggagcagagaatgaaagttggtagaaagcatactccggaattatttctctatattgtcttaaattgccaaaataaggccttaaaaaatataacccaaagaaatatagtgcagtttcagcctaaaacactaagcagcatgacaattacgttttttgcttgcctattggtgaaaaagttctcagtttgagctttagaggttgagtgacaatgtttgtgtctttcagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtc

SEQ ID NO: 126596 - DNA, 2909 bp, Homo sapiens
  Payload ID: 4826
  Gene Symbol: DGKA
  Gene Name: diacylglycerol kinase, alpha 80kDa
  Uniprot ID: P23743
  ENST ID: ENST00000331886
  CDS Start-End: 455-2662
acacaatacccacacatgcatatacccttctagtcagaggtctcccctcccccttcttcccacccccaggtgtaagaaggacgattccaggaacctaaggctttgttactctgccccattttcaatgaagggtaggagggagttagacaggggttggggcggggccagtgagcaggatgcctgggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttggga

SEQ ID NO: 126597 - DNA, 2770 bp, Homo sapiens
  Payload ID: 4826
  Gene Symbol: DGKA
  Gene Name: diacylglycerol kinase, alpha 80kDa
  Uniprot ID: P23743
  ENST ID: ENST00000394147
  CDS Start-End: 310-2517
gcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgct

SEQ ID NO: 126598 - DNA, 2582 bp, Homo sapiens
  Payload ID: 4826
  Gene Symbol: DGKA
  Gene Name: diacylglycerol kinase, alpha 80kDa
  Uniprot ID: P23743
  ENST ID: ENST00000402956
  CDS Start-End: 205-948
agcccagctcgggctccagctccagcgccggcgcttcagctgcgaccgcgagccctctcaagcaaggtagagaccccgcgagccccccagcgccccaccctcccccatcggaaaaggacaggggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaaccgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaagtaa

SEQ ID NO: 126599 - DNA, 591 bp, Homo sapiens
  Payload ID: 4826
  Gene Symbol: DGKA
  Gene Name: diacylglycerol kinase, alpha 80kDa
  ENST ID: ENST00000432422
  CDS Start-End: 243-591
agctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaat

SEQ ID NO: 126600 - DNA, 556 bp, Homo sapiens
  Payload ID: 4826
  Gene Symbol: DGKA
  Gene Name: diacylglycerol kinase, alpha 80kDa
  ENST ID: ENST00000546878
  CDS Start-End: 383-556
attactgagcgcttgctgcctgtaaaacagtcctcagggagccaagagaagttccgaggcacagtccctctcatccccaggaactcctcgtacgtccaggacctgcgagggaaaagggcgcaaggcccacctgcacccaaaaagggggccttataaatgaagaaaggaagaatatccaggctctggcctgcacccagatctcagagcggcttggtgacgtggagcagacaaactccaggaacgcactggggcgcacaagtgtttctagggacggttggagaccctatctaaccctaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaa

SEQ ID NO: 126601 - DNA, 1734 bp, Homo sapiens
  Payload ID: 4826
  Gene Symbol: DGKA
  Gene Name: diacylglycerol kinase, alpha 80kDa
  Uniprot ID: P23743
  ENST ID: ENST00000553084
  CDS Start-End: 212-568
ttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatggtcttaagaaacagaagaggatggggggagaggttgagtcctctaggactaaatttgaaagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtg

SEQ ID NO: 126602 - DNA, 567 bp, Homo sapiens
  Payload ID: 4826
  Gene Symbol: DGKA
  Gene Name: diacylglycerol kinase, alpha 80kDa
  ENST ID: ENST00000549368
  CDS Start-End: 126-567
gactggggaaaataggtctaaaaggaaagaggaacgtgaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaat

SEQ ID NO: 126603 - DNA, 605 bp, Homo sapiens
  Payload ID: 4826
  Gene Symbol: DGKA
  Gene Name: diacylglycerol kinase, alpha 80kDa
  ENST ID: ENST00000551707
  CDS Start-End: 207-605
gtcagaagcgctagaggtcgttgcgtggcgtgggtggctcggggagtgggtggctgagcggagctggggtccctggccagaggcggaacaaaatggggtcatggccaggaagacgcgctaacgcagcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctca

SEQ ID NO: 126604 - DNA, 563 bp, Homo sapiens
  Payload ID: 4826
  Gene Symbol: DGKA
  Gene Name: diacylglycerol kinase, alpha 80kDa
  Uniprot ID: P23743
  ENST ID: ENST00000548549
  CDS Start-End: 126-482
gactggggaaaataggtctaaaaggaaagaggaacgtgaagaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatggtcttaagaaacagaagaggatggggggagaggttgagtcctctaggactaaatttgaaagaagtggacaaaattatcctacagatga

SEQ ID NO: 126605 - DNA, 542 bp, Homo sapiens
  Payload ID: 4826
  Gene Symbol: DGKA
  Gene Name: diacylglycerol kinase, alpha 80kDa
  ENST ID: ENST00000547015
  CDS Start-End: 479-542
atgatctcggctcactgcaacctctgcctcccaggttcaagcgattctcctgcctcagcctcgcgagtaactgggactacaggcatgtgccaccacgcccggctaattttttgtatttttagtagagacaggttttcaccgtgttagccaggatggtctcaatctcctgatctcgtgatccgcctgcctcagcctgccaaagtgctgggattacagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaat

SEQ ID NO: 126606 - DNA, 585 bp, Homo sapiens
  Payload ID: 4826
  Gene Symbol: DGKA
  Gene Name: diacylglycerol kinase, alpha 80kDa
  ENST ID: ENST00000550888
  CDS Start-End: 57-407
aacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaatgaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctg

SEQ ID NO: 126607 - DNA, 2671 bp, Homo sapiens
  Payload ID: 4826
  Gene Symbol: DGKA
  Gene Name: diacylglycerol kinase, alpha 80kDa
  Uniprot ID: P23743
  ENST ID: ENST00000551156
  CDS Start-End: 205-2412
agcccagctcgggctccagctccagcgccggcgcttcagctgcgaccgcgagccctctcaagcaaggtagagaccccgcgagccccccagcgccccaccctcccccatcggaaaaggacaggggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaagtaa

SEQ ID NO: 126608 - DNA, 548 bp, Homo sapiens
  Payload ID: 4826
  Gene Symbol: DGKA
  Gene Name: diacylglycerol kinase, alpha 80kDa
  ENST ID: ENST00000555025
  CDS Start-End: 417-548
agaagcagagctgccgccggcgcgggaagaagatgaggagcgcagcaaatggagaaaatgtgtccaaagccccggacatattcgagggagggtggagcaggttatggtgaactggaaacctagaaacgggcctctccaacttcgaagttcccagagtcgggggcgccgggcgcgggcgcggcgggcaggctggggtggggggcgggcagctatgtcgtcaggaacggggcggccccgctgcggccgcgtctgcctggcccgtcccctccagcccagctcgggctccagctccagcgccggcgcttcagctgcgaccgcgagccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 126609 - DNA, 548 bp, Homo sapiens
  Payload ID: 4826
  Gene Symbol: DGKA
  Gene Name: diacylglycerol kinase, alpha 80kDa
  ENST ID: ENST00000549629
  CDS Start-End: 265-548
agttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatcttcctcagtggctttgagcagtgtgctgctcagatgtgcccatgactggaaatgggaggagtgggagatggggagatgtcagaaaaagatccggatctaccacagtctaactgggctgcattgtgcaaggtctcggctctctacccaccttcgctatacctggactgcttgctccagctctcagagaagaggagtaaagagtgactccaccaaaaaggt

SEQ ID NO: 126610 - DNA, 564 bp, Homo sapiens
  Payload ID: 4826
  Gene Symbol: DGKA
  Gene Name: diacylglycerol kinase, alpha 80kDa
  ENST ID: ENST00000553783
  CDS Start-End: 243-564
agctcgggctccagctccagcgccggcgcttcagctgcgaccgcgagccctctcaagcaagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagg

SEQ ID NO: 126611 - DNA, 497 bp, Homo sapiens
  Payload ID: 4826
  Gene Symbol: DGKA
  Gene Name: diacylglycerol kinase, alpha 80kDa
  ENST ID: ENST00000556001
  CDS Start-End: 98-497
agccctctcaagcaaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcag

SEQ ID NO: 126612 - DNA, 698 bp, Homo sapiens
  Payload ID: 4826
  Gene Symbol: DGKA
  Gene Name: diacylglycerol kinase, alpha 80kDa
  ENST ID: ENST00000557180
  CDS Start-End: 1-294
tgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtcccctccctcccctaggtcctgctcagaccctgccagacaaggaactgcctttctccccaaggtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttg

SEQ ID NO: 126613 - DNA, 607 bp, Homo sapiens
  Payload ID: 4826
  Gene Symbol: DGKA
  Gene Name: diacylglycerol kinase, alpha 80kDa
  ENST ID: ENST00000552903
  CDS Start-End: 1-607
ctgcggattgaccctgttcctaacacccacccacttctcgtctttgtcaatcctaagagtggcgggaagcaggggcaaaggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgt

SEQ ID NO: 126614 - DNA, 1900 bp, Homo sapiens
  Payload ID: 4826
  Gene Symbol: DGKA
  Gene Name: diacylglycerol kinase, alpha 80kDa
  ENST ID: ENST00000555218
  CDS Start-End: 265-1900
agttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcaggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaacc

SEQ ID NO: 126615 - DNA, 505 bp, Homo sapiens
  Payload ID: 4826
  Gene Symbol: DGKA
  Gene Name: diacylglycerol kinase, alpha 80kDa
  ENST ID: ENST00000557080
  CDS Start-End: 374-505
gctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcggatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 126616 - DNA, 569 bp, Homo sapiens
  Payload ID: 4826
  Gene Symbol: DGKA
  Gene Name: diacylglycerol kinase, alpha 80kDa
  ENST ID: ENST00000555090
  CDS Start-End: 438-569
attttcaatgaagggtaggagggagttagacaggggttggggcggggccagtgagcaggatgcctgggtctccagttcctgccagtgagtccctaggcctccatctctctcccttgctgtaccaccttcaccaccatccatgcgaccccaagagccttaatgactctagaagagactccaggcaggggaagctgaaaggacctttcactccctacttttggccagggccttctgtgccacctgccaagaccagcagatataacttccccaagtcacacagtggtatcagagctaagaatgggacccagatatgactgatctagttctgttccaaaaccgtgctgtattatattaacgcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaa

SEQ ID NO: 126617 - DNA, 6684 bp, Homo sapiens
  Payload ID: 4827
  Gene Symbol: DGKB
  Gene Name: diacylglycerol kinase, beta 90kDa
  Uniprot ID: Q9Y6T7
  ENST ID: ENST00000399322
  CDS Start-End: 188-2602
ttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatctacatagaaccagaaagtttaaaagacgtaaatttattttttccacttccttgtgtacaccatgtatttcatgtgaaaatgctgatcaatttattgtggtggaaggagatatcttgcaggaagtttaaaaattaacattttaaaacagtttttattttatttaaaacaggttcatgtgatcatagccagaataaaacaaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaaaattagccaggcatggtggcacatgcctgtaatcccagctactcgggaggctgaggcagaagaattgcttgaactcgggaggctgcggttgcagtgagccaagatcacaccactgcactccagcctgggtgacagagccagactctgtctcaaaaaaaaaaaggaaaatgtacttttcatggcacgtataacccccaaaggattattcaatactgaacaattaaataataattgaataatattgaatcatgttctccgttatttttcaaataactgaataatatctctattaaaagattaaacccttgtaacatatattaaagctgtaaactttaagaaaataaataaataaaaccctgtaaaagagcttttattttgtgagaggcagaaatcaccacttaaaactcccaattaaattctgctatatttaaataaagtttgagtaaactcacatttgagagattctgtataaccttattgtgtttaaaaacatggaacttaattatagtaccttaattattttctcagaaatgatatatacaatatcctgttttttgaaataaaaacgttaaccactca

SEQ ID NO: 126618 - DNA, 5595 bp, Homo sapiens
  Payload ID: 4827
  Gene Symbol: DGKB
  Gene Name: diacylglycerol kinase, beta 90kDa
  ENST ID: ENST00000402815
  CDS Start-End: 287-2698
ggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatc

SEQ ID NO: 126619 - DNA, 3651 bp, Homo sapiens
  Payload ID: 4827
  Gene Symbol: DGKB
  Gene Name: diacylglycerol kinase, beta 90kDa
  ENST ID: ENST00000407950
  CDS Start-End: 439-2829
atctttcagacactagttccaatgggccgggtgttctggaagggggtggcagtggggaggaggatgctgtgagcagagttcttgaagctccactcctctggggaagccgagctgtgtgggagccttcttactgtgccgggagcgtgtgaattggaaaggatcctgagaactggctagtcccagttcctctccggaaaagcagtggctctcgcttcagagatgcgctcagctttcgcctgcatcacactgcattctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaa

SEQ ID NO: 126620 - DNA, 6917 bp, Homo sapiens
  Payload ID: 4827
  Gene Symbol: DGKB
  Gene Name: diacylglycerol kinase, beta 90kDa
  Uniprot ID: Q9Y6T7
  ENST ID: ENST00000403951
  CDS Start-End: 421-2835
attttcccctgagctccatcagcaagagtagcaatagcagctggagaagcggcagccagagataggcagggctggtgcttgcagccgcgcaaatcgcctcctcctcaacacacacacacacacacacacacacacacacacacacacactgcacagacttccaatatcaacgcgtcttgacataaatcaaggactaagagagactgaagaagagcgttagtcatggacaacagttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcgagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctataatggaagattacgtacaaagtgtattcttttagtgttcctggaacattggacggtaaatatcaatcaacaataagcttaattactttaaaaataaaagcttttgaataaaattaagacataatttagcattcccaggaaaattatgattacaattgcaaatttagtacagcaatcacttgcgctggtataaaataaaaaagttgtttggcagaagagtaatccagaccaaaagaaagaaagaaatctcaaaacagtaacaagtacattactgacataatgttacgtaacacacacattgattttttgtatctatggttgcaggtaataaatattttcacatgaattgacaaaattttctacaatgggcaggcaggctttgtgtcaaaaacatattttgaagccacaaattattttatgttcgctacaacatacaattatgtcttggctaccttttatagtatatagtttgaaggcagcaacagtttgtgaatcattcttaacaatctgtacagtagaaagctgttggatagacagtgggatgagacaaattaaacaacctgcttataagatttcaatgattgaaataatgggatgcagcttcacttcagtgtagctgtataactacaattagtgctaatagtggttacattttcagtcagatggattctttggtacccataataaatgttcaaataggaatccaatttgacttttctcaactcattttctaaatacactgatgtacttgccccttcaagtatactgcccctggggtttggaaagtagtttttaaaaacgtaacttgatgggtttgaaatcagagaagatattctcatcagttttatgacagcttcatatgaaaaatatatagtttaaggaaaattctatagtatattaaaatattgaatgatgaatgttgttagctttacaagatggaaacttctcttctatgtgtgcagataaattttcagctattgagtcgccctcttttaatataggagacataaagttttaagtggctgaaactcttaaatgtaaattaatgctggacttaacagcagtcagaaacaaagagggaaaagagacatgcactctgctaaacattgctaggcactgagttgatgagattccagagagacatttcagagtaaaccttgatatccacgcttctaagagataggaagggaggtatctacatagaaccagaaagtttaaaagacgtaaatttattttttccacttccttgtgtacaccatgtatttcatgtgaaaatgctgatcaatttattgtggtggaaggagatatcttgcaggaagtttaaaaattaacattttaaaacagtttttattttatttaaaacaggttcatgtgatcatagccagaataaaacaaaaggctcagatgtttagcctagtctactgcagacagaaatttaaatccagtgagggctaatgaatcacatacgtgtttccacattttattttgttttcgttttttaggcatatgggaagtagttgcaatttttcagggaagaatatgttttgaatctcacactgtattctccttgaatctcacactgtattcttgaatgagacaagattttgagatcattcttttcctttttgtgtcaacgttagtttgttgttcattggttataaaaaggaaaatgtggccaggcgcaatggcttacgcctgtaatcccagcactttgggagacagaggcaggcagatcacaaggtcaggagttcaagaccagcctggccaatatggtgaaacctcgtctctactaaaaatacaaaaattagccaggcatggtggcacatgcctgtaatcccagctactcgggaggctgaggcagaagaattgcttgaactcgggaggctgcggttgcagtgagccaagatcacaccactgcactccagcctgggtgacagagccagactctgtctcaaaaaaaaaaaggaaaatgtacttttcatggcacgtataacccccaaaggattattcaatactgaacaattaaataataattgaataatattgaatcatgttctccgttatttttcaaataactgaataatatctctattaaaagattaaacccttgtaacatatattaaagctgtaaactttaagaaaataaataaataaaaccctgtaaaagagcttttattttgtgagaggcagaaatcaccacttaaaactcccaattaaattctgctatatttaaataaagtttgagtaaactcacatttgagagattctgtataaccttattgtgtttaaaaacatggaacttaattatagtaccttaattattttctcagaaatgatatatacaatatcctgttttttgaaataaaaacgttaaccactca

SEQ ID NO: 126621 - DNA, 3257 bp, Homo sapiens
  Payload ID: 4827
  Gene Symbol: DGKB
  Gene Name: diacylglycerol kinase, beta 90kDa
  Uniprot ID: Q9Y6T7
  ENST ID: ENST00000406247
  CDS Start-End: 85-2406
ggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccggactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacagtgagtacagagtagttgatatgctatgtcaatctcagttttgctttcctctttgactaaataaccacaataactgatttttttctttatttcttttcaacctatcagcaaatagtctttttgttgttgttgttatgtgtgtgtcagagccactacatttaggttgtagacattatatacccttggcaatgatttagctcttgaatgtttgtgttagcctaagtataaatagatcttttaaatagatcaattataaaccatagatcaattataaactatggagctaaacaaaatattaataaaagtttatctgaaacttttttgtttatttcagagcacattattagaatattatttgcaagaaatgcagacctaagcttatatgtgaacttatttctcagcttttctatgcctccatttggggatttgagggctttcttctccataagaaaaaaatttctctccagtttctaccataattaattgtgttttccagaatgaggtattatttaaggcagacactgcccctctcaaaaaaaaatcagttttcatttgcatagtgaatattttattgcatttcaaaaacatgctaggaactgcttttggcactgggagtagacacatgaacaagaccaacagtgtaatttccttcaagttacttacattcctataatagaggaccgaataaataaacaactacatgataaatataacttcagactgtgagagttattaaaaaataaggtgaaatgatgataagaagctggattaggtgtggagaataaatactacttgagataagggagacctctttgaaaggacatagccaaaagcttagtataaaattaaaaaaaataaaaaaaaaa

SEQ ID NO: 126622 - DNA, 494 bp, Homo sapiens
  Payload ID: 4827
  Gene Symbol: DGKB
  Gene Name: diacylglycerol kinase, beta 90kDa
  ENST ID: ENST00000437998
  CDS Start-End: 270-494
acataaattagtaccttactggctagggaatgttgaatcacagttggatgaagaaacaattcatgttaatgtttctctaaagttctttaacacattattgaaattacaagcatccaaagcagtttcatgtggacagattgcatattttgaaagcctgaggtattttatcatgaaacatgccatgtggaatctttgaagcatagacctctgcgcaacacctgaataaagaatcttttacctggtatgtgacagagcttctcaccaccaccatgacaaaccaggaaaaatgggcccacctcagcccttcggaattttcccaacttcagaaatatgctgagtattctacaaagaaattaaaggatgttcttgaagaattccatggtaatggtgtgcttgcaaagtataatcctgaagggaaacaagacattcttaaccaaacaatagattttgaaggtttcaaactattcatgaagacattcctggaagccgagctt

SEQ ID NO: 126623 - DNA, 6297 bp, Homo sapiens
  Payload ID: 4828
  Gene Symbol: DGKD
  Gene Name: diacylglycerol kinase, delta 130kDa
  Uniprot ID: Q16760
  ENST ID: ENST00000264057
  CDS Start-End: 13-3657
tggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttccatc

SEQ ID NO: 126624 - DNA, 6228 bp, Homo sapiens
  Payload ID: 4828
  Gene Symbol: DGKD
  Gene Name: diacylglycerol kinase, delta 130kDa
  Uniprot ID: Q16760
  ENST ID: ENST00000409813
  CDS Start-End: 80-3592
agagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttc

SEQ ID NO: 126625 - DNA, 5379 bp, Homo sapiens
  Payload ID: 4828
  Gene Symbol: DGKD
  Gene Name: diacylglycerol kinase, delta 130kDa
  ENST ID: ENST00000430834
  CDS Start-End: 1-1355
gaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagaaaggagccagacacagagcccacgaccgcatgatcccattcctgtgaactgcctagaagaggcgcctccgtggaggtggaaagtagacgagaggcgccagggatgagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttccatcgcca

SEQ ID NO: 126626 - DNA, 494 bp, Homo sapiens
  Payload ID: 4828
  Gene Symbol: DGKD
  Gene Name: diacylglycerol kinase, delta 130kDa
  ENST ID: ENST00000447484
  CDS Start-End: 1-494
agcccaagatcgcagactctcatccgccctcagaaagattgtgcgtgtgcgtgtgtgtgcgtgtgtaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcga

SEQ ID NO: 126627 - DNA, 482 bp, Homo sapiens
  Payload ID: 4828
  Gene Symbol: DGKD
  Gene Name: diacylglycerol kinase, delta 130kDa
  ENST ID: ENST00000427930
  CDS Start-End: 12-482
ggcccggcagcatggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaaggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatc

SEQ ID NO: 126628 - DNA, 6222 bp, Homo sapiens
  Payload ID: 4828
  Gene Symbol: DGKD
  Gene Name: diacylglycerol kinase, delta 130kDa
  ENST ID: ENST00000622717
  CDS Start-End: 80-3586
agagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacggcgacccatcccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttc

SEQ ID NO: 126629 - DNA, 625 bp, Homo sapiens
  Payload ID: 4828
  Gene Symbol: DGKD
  Gene Name: diacylglycerol kinase, delta 130kDa
  ENST ID: ENST00000442524
  CDS Start-End: 1-490
gccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggctgaagtgcggtggtgtgatctcggctcactgcaacctccgtctcccaggttcaagggatcctcatgcctcagcctccctagtagctgggattatagtcgtgcaccgttatgcccagataatcttcgtaattttagtagagatggggtttcaccatattggccaggctggtctcaaactcctggcctggagtgatctacccgcctgaaccttccaaagtactgggattacaggcatgagccactgtgcctggccctgggcattaatttagatgttcattttggtttcagttatttgcatatttcctaataaaaaaattattcttggtaa

SEQ ID NO: 126630 - DNA, 5379 bp, Homo sapiens; identical to SEQ ID NO: 126625
  Payload ID: 4828
  Gene Symbol: DGKD
  Gene Name: diacylglycerol kinase, delta 130kDa
  ENST ID: ENST00000630624
  CDS Start-End: 1-1355

SEQ ID NO: 126631 - DNA, 6222 bp, Homo sapiens; identical to SEQ ID NO: 126628
  Payload ID: 4828
  Gene Symbol: DGKD
  Gene Name: diacylglycerol kinase, delta 130kDa
  ENST ID: ENST00000629655
  CDS Start-End: 80-3586

SEQ ID NO: 126632 - DNA, 625 bp, Homo sapiens; identical to SEQ ID NO: 126629
  Payload ID: 4828
  Gene Symbol: DGKD
  Gene Name: diacylglycerol kinase, delta 130kDa
  ENST ID: ENST00000626849
  CDS Start-End: 1-490

SEQ ID NO: 126633 - DNA, 494 bp, Homo sapiens; identical to SEQ ID NO: 126626
  Payload ID: 4828
  Gene Symbol: DGKD
  Gene Name: diacylglycerol kinase, delta 130kDa
  ENST ID: ENST00000629742
  CDS Start-End: 1-494

SEQ ID NO: 126634 - DNA, 6297 bp, Homo sapiens; identical to SEQ ID NO: 126623
  Payload ID: 4828
  Gene Symbol: DGKD
  Gene Name: diacylglycerol kinase, delta 130kDa
  Uniprot ID: Q16760
  ENST ID: ENST00000628356
  CDS Start-End: 13-3657

SEQ ID NO: 126635 - DNA, 6228 bp, Homo sapiens; identical to SEQ ID NO: 126624
  Payload ID: 4828
  Gene Symbol: DGKD
  Gene Name: diacylglycerol kinase, delta 130kDa
  Uniprot ID: Q16760
  ENST ID: ENST00000628527
  CDS Start-End: 80-3592

SEQ ID NO: 126636 - DNA, 482 bp, Homo sapiens; identical to SEQ ID NO: 126627
  Payload ID: 4828
  Gene Symbol: DGKD
  Gene Name: diacylglycerol kinase, delta 130kDa
  ENST ID: ENST00000625865
  CDS Start-End: 12-482

SEQ ID NO: 126637 - DNA, 8660 bp, Homo sapiens
  Payload ID: 4829
  Gene Symbol: DGKE
  Gene Name: diacylglycerol kinase, epsilon 64kDa
  Uniprot ID: P52429
  ENST ID: ENST00000284061
  CDS Start-End: 181-1884
ctccagctcgcggccccgcgcgccggatcggcgtgcgtgcggctggagccttaagcgtttcccccgcccggcttcatccctgctggcggcccagcgtcgttctcctcctgcgcgaggcggccaaggcctgctggcccggagccgcgcctccacccgcgcgaggtatcgtccttggagaagatggaagcggagaggcggccggcgccgggctcgccctccgagggcctgtttgcggacgggcacctgatcttgtggacgctgtgctcggtcctgctgccggtgttcatcaccttctggtgtagcctccagcggtcgcgccggcagctgcaccgcagggacatcttccgcaagagcaagcacgggtggcgcgacacggacctgttcagccagcccacctactgctgcgtgtgcgcgcagcacattctgcagggcgccttctgcgactgctgcgggctccgcgtggacgagggctgcctcaggaaggccgacaagcgcttccagtgcaaggagattatgctcaagaatgacaccaaggtcctggacgccatgccccaccactggatccggggcaacgtgcccctgtgcagttactgtatggtttgcaagcagcagtgtggctgtcaacccaagctttgcgattacaggtgcatttggtgccagaaaacagtacatgatgagtgcatgaaaaatagtttaaagaatgaaaaatgtgattttggagaattcaaaaacctaatcattccaccaagttatttaacatccattaatcagatgcgtaaagacaaaaaaacagattatgaagtgctagcctctaagcttggaaagcagtggaccccattaataatcctggccaactctcgtagtggaactaatatgggagaaggactgttgggagaatttaggatcttgttgaatccagtccaggtttttgatgtaactaaaactcctcctatcaaagccctacaactctgtactcttctcccatattattcagctcgagtacttgtttgtggaggggatgggactgtagggtgggtcctggatgcagttgatgacatgaagattaagggacaagaaaagtacattccacaagttgcagttttgcctctgggaacaggcaacgatctatccaatacattgggttggggtacaggttatgctggagaaattccagttgcgcaggttttgcgaaatgtaatggaagcagatggaattaaactagatcgatggaaagttcaagtaacaaataaaggatactacaacttaagaaaacccaaggaattcacaatgaacaactatttttctgttggacctgatgctctcatggctctcaattttcatgctcatcgtgagaaggcaccatctctgttttctagcagaattcttaataaggcggtttacttattctatggaaccaaagattgtttagtgcaagaatgtaaagatttgaataaaaaagttgagctagaactggatggtgagcgagtagcactgcccagcttggaaggtattatagttctgaacatcggatactggggcggtggctgcagactatgggaagggatgggggacgagacttaccctctagccaggcatgacgatggtctgctggaagtcgttggagtatatgggtctttccactgtgctcagattcaagtaaaactggctaatccttttcgaataggacaggcacatacagtgaggctgattttgaagtgctccatgatgccaatgcaggtggatggggagccttgggcccaagggccctgcactgtcaccataactcacaagacacatgcaatgatgttatatttctctggagaacaaacagatgatgacatctctagtacttcggatcaagaagatataaaggcgactgaatagatggatgagggagtgaaaactttgcatagaatcctcacgcaagtagatacatgttcatccaaaagtattaatagaaattctctatcagctattcagtcttaatttcactagtagtataatgggtatacatttttgtaaatagcatccccaaaccagccagccttcagttatttacaaatgtttgttcttttttcagcaaaatacttcaaatgaatagtattaacttacaaaaagtcacaaaaacttacatgagagtgaaaatttgttatgactgttttgagagtgggactcactctgaagtatgtgctgtctcatgtcttatttttgaaccatgcatatgatggacacacaatggatggacacattatatctccaacaaggtgtgggtggaaagatcaaattaacctgcttttttgaaaggaaatgattactgtcaaaccagcatggttaattgtgagcatcctcctgcagcatgccccttaagattttctacaacccaaaccaagtgtatgtattgatttctaggaacccccaaaaggagaatagtaaaaaaagatcatacttaaaatttgtattacaatttttattttaggaacttattcagacacgtaaatgttgtttaattctgtaggtaaccatttgagctgcaattcaggatcttttttataacaccagtgtagccaaaagagaaacagataagtgaattggtaagaaataagattcagagcacttgggattgtaagttataggttctgagctgaactgtttatcagccgctctttttattaaaagacagtgtcaacacttcaaaaaacgtgcttaaaggagacaacggtgagattaattgcttagaaaaagctcaaggctgactgataagttttaaaaatttggtggtcttgtagtattttgaaatacagtagtcttttaacagaatttccccttagggaggtaagtggacagaaatctttgctaaaatgtttatatcatatttattttaaaatgagagagatatatttttaaattatttattatttaccttgtggtatggtacctgtgtttagtgtttacgttctgtagctttatttaataagttaaattgatcacataaattctgctagtcacaatcagatagaaatttagtctattaattaaaattctaatttaattctcctgacagaaatctagatattcttattcttcacaaatattcctcattgtattgaaaaatgaaggagggcatgaaaagcactagggaactacttttggataactgaaagctttgtttcattgttttatttgcccctcaattgccacaaacttactgaagggctagtttcatggttcccattagagggtgcttgttcgctgctgttgaccagcccaagggtcgtgacccacaggtcggctgacccagagggcatccagcctggtgtttttctgacacatggcccaggctttgtggtctttcatgacattaatctctgaaagatcagaatgtatcccccaaaataccattagctatctttgagggtctattatgaatctgtcatccatgaattgccataaacctaagtttgcctcacctcaggcccagaccatgttttcaaagagcaacttagtaatgtatacagtagtcagtacattttatgaaatactctattttgctaaattaacctcttgcagatctcctcaggtgatcttaaattctagtcttgagaaactttgtgagcagatctgttttcagcttctttatatacctttcatggtaagtaaccatggcagtgaggatggcagagttttgttttttttttttttaatgggccaatcatgttctgagtattatgaagtttatcctttcattcatgatcaaaattgttaaagacatcacattttataaatacactgttaaatccactttgctgtaggttatagtttacctgttatataattcgtagtgctaattgtagtagaagcaaatcaatttaggatgttggaacgaaaataatcacaataactaatacagctttttaattgtgaaaactacaattaaaaattataattttaataccaaccataatattacactgtatttagaacaggcttatgtaaaatgccctcatttatctaaataagttgattttttggttattgtaatctagtaaggtttttgcatcactactggtctgtcatgaagtttttctgctggcttattcacttatttagacttcatttagggaagctatttcagaataccatctcataaaatgtatcattatcttgtttttgcaaaattcacttactttttgggcacatttacccagcatttcaaataagtgtataggcatgtgccttgtttaagtacaatttataagacttcatgtttgcaagttacatattagggtagtgattgtttatattaccagggattctacactttaccaaaaaaaattgccataagattttcctgttccattttaaattgtcttgatatttaaaaaaataacttctacattctcaggaagaaatacatgaagtaaatcatatctccatgtctgtttccagatttctctaatctttttactatcccaatacattcctaattcctataaacgtagtggcttaaatactgaatacctggcagctcttaaagatcccttaggcagatgatgataattttcagtgtttcgtcatgtttaatagaaatcaaactgacttgtgttttaaaatacaagttgtctgctagtaaagttacatgatttaggtgtgttttaggttttctgcaacaattagctgtgaacccctaatgtagctaagtttatacaaattttataatcaaaattatttatttttatttttttagagtatgtcaaaaacatatagtgtttgctttgtgaaatacatttgcttagagttataaaatatactgtgactcagaaattgtaaagtcagtttgcgttgtaaaaatgaatactaccagcatgtcaaaagaaaaataatttacatttgtaatataaagtaaaattgtatttaatatatttattgaattttaaatttgcactaacttgaaaactttaaaggttatactaatttaatgattaatgtggacccaaatacataatttggccaaaaaagtcattagaatgggtaatggttttgtgtggttttccttcaaaatgataatattgaagcaagaaccagcattttatattgataatttttttaatatttctacccagttgaggacagtggaatataagtagatatatttaaaatatctagatatttaaaaagaaagaaaaggttgtttatcccaatctgaattcattctcagcaacaagacagaaaaggtggtttgggttttgcttttaaacagtgtccccctgtctttttcaatttttcccttgaagcctttctcttgttcttcagagtacgcgctgcaggctatctgcagcatcagaatgcctgggcaggctgttgaaagtatggattcctgagcccaacccttaacttaatgattccctgtctctggagatgcaacatagaaatctctgtttttattaacaagcgcctcaggcgattcttaagcatactgaaatttgaaagcttctggtctgaacctcatgtattcacctagggcttttgctaggtgggataccatgccgaaaaattgaattaattgtatgttcttaaaattgtttttcttctactccgctgtcctcttccctcaaaatcacttttctaaaagaactctatgaaaaacttatttgtatcatacccaaattgatatatttgtctgaactctgttacataaaaattggtatgattcatatgtggaatcagtttttggactgtgacccatgcagtgttgggggacaaggagttgcttcaggagttagtgcagtgcgcctccaaggggcagtgagccatggaggcgcctgccttctcactgcagtcaatgcagccacacttgtgtatactgagtgctgcttcagatctcagtagataaaataattccacatttaaaatgattctgctattttttataaagggtttgaaagccactactataatgactttgtcacctaattgattttctactaatttttacatattcagaaacttcgtgtttttttggtggacagaatattttggaggtctccgtcgctgtttagaatgtggccacttggctgtttcacagtttttaaagctattttattgaatagtaaagcagtgaacttagcctttgttctttgtgtttctaatttaagcatatagtctatttaatttttgatatgtaaatacacatcaatacatatatatttacccatgtggccctgtgtagtcagtgcatgaggcttgcatagcccagaaaggtacattccagggttctggggaaagaattttaaaatgccatcctctaatacagacgtttataaaacttaaatgaaatgattgggcttaaccatatgcaagaaagtctgcagaaaataaatcacctagaaactataaatagaaatgtgctgctgaggctgggcacggtggctcacacctgtaatcccagcacttggggggctaagggaggcgtatcacctgaggtcaggagtttgagacaagcctggtcaacatggtgaaacgccgtctctactaaaaatacaaaaaaaattagccaggtacattggcacatgcctttaatcccagctaatcaggaggctgaggcacgagaattgctcgaacccaggcggcagagcttgcagtgagcggagatcacatgactgcactccagcctgggcaacagagcaagactccatctcaaaaaaaaaaaggccgggcgtggtggctcacgcctgtaatcccagcactttgggaggctgaggcaggtggatcacgaggtcaggagatcgagactatcctggctaacacggtgacaccccgcctctactaaaaatccaaaaatttagccgggcatggtggcgggcacctgtagtcccagctactcgggaggctgaggcaggagaatggcgtgaacccgggaggcagagcttgcagggaggcggagcttgcagcgagccgagatagtgccactgcagtggggcctgggccaaagagtgagactccatctcaaaaaaaaaaaaaaagaaagaaatgtgttgctggtatcagatatcagaccaagaacacttcagtctctctaaggatgccctgagctacctcactgttaaaggacgacatcaacacagaatgcactaaacaggaaataagctgtaatctagagaatttccattatgtgttactttttggtgactaacatggaatgttgaaaaggaagagctggaaagctcagttgttttccttgttcctctgacattgtccaggcaagagggcatcctgatcagatgagtagatttggctgagaaaaaccctagagtaaggcaggcactttgtggaggtggatgatgatggctcataaaaacgtttgttctcagtccagttcagggctctgccagcagtctttcagatctgaactgcttaaacaaaccctacagataaattggcactctgatttgtaattctgtttgtacaagtttagagcagcctagctcgagtcctcaaccccagtcctcttagaagtgaactgattgcactggatccctaaacccacaatgttgaggacacatgtgatgactccacttgctcagccagctggcctcttgcactttcccctgcccaccacttgtaactaccacttaattatcttgtgttaattgcttttgttgtgttgggtctgtatttttgtggtcagtgcctgcaggcagaaatgtgaaagcatttggtatgttgaagatacttgcttcttttttaataaaattaaaagtgcagcacgtaagtatgatactgtgtagttttttgacacaaccatgagatacaataagcagctttgacttagtgtcccaaaaagtggttcttggtctacagcagggcaaacatatatgtggcaagttctgatcacatacttttagacagaaagaataaaaaattcatattgcatggcttttgtagcctaagagcacagaatcatacacgtgtgttaggagaaacattcattctcacgcatataaactggctcctggcagagtagagcagtaagtgggatcaaaggtgaattcaccttattttcagttggtagagtatggaaaaatgtatcacttatttgaaatacctgaatggaaacccagcctctactactgtaacttaacacttgttcttcctgagcctcaaattttctttctctgtaagaatgggaattaatgcccacctacgggttgcaagtgcttacaggagctgggcaagcaacgaaggtaagagttgtagagacttcggtaaactggagcacatgattcctgggaagcaggcctagtgtaaacaatttatttttctagaaaagacagaagtttagagtatatgaaatctaatttttaagtattggttggcaactaattgactatcgtctaccataaggttatatgataattattagggcaggagagtgaatgcatcttaatatgcatggcagaactgtgtgtttccttccatctggattttcataaagctttctgatttatcagtaacgatctgaaaaatgtactgtggcatgtaacatcttttattcattttattaggcattagaggaagaatattctgtagtcctgctttattctgccatctttacctggaaatccatttttataaaatttttgtaataaaaattcacttgatca

SEQ ID NO: 126638 - DNA, 5179 bp, Homo sapiens
  Payload ID: 4829
  Gene Symbol: DGKE
  Gene Name: diacylglycerol kinase, epsilon 64kDa
  ENST ID: ENST00000572944
  CDS Start-End: 1-1369
gagcaagcacgggtggcgcgacacggacctgttcagccagcccacctactgctgcgtgtgcgcgcagcacattctgcagggcgccttctgcgactgctgcgggctccgcgtggacgagggctgcctcaggaaggccgacaagcgcttccagtgcaaggagattatgctcaagaatgacaccaaggtcctggacgccatgccccaccactggatccggggcaacgtgcccctgtgcagttactgtatggtttgcaagcagcagtgtggctgtcaacccaagctttgcgattacaggtgcatttggtgccagaaaacagtacatgatgagtgcatgaaaaatagtttaaagaatgaaaaatgtgattttggagaattcaaaaacctaatcattccaccaagttatttaacatccattaatcagatgcgtaaagacaaaaaaacagattatgaagtgctagcctctaagcttggaaagcagtggaccccattaataatcctggccaactctcgtagtggaactaatatgggagaaggactgttgggagaatttaggatcttgttgaatccagtccaggtttttgatgtaactaaaactcctcctatcaaagccctacaactctgtactcttctcccatattattcagctcgagtacttgtttgtggaggggatgggactgtagggtgggtcctggatgcagttgatgacatgaagattaagggacaagaaaagtacattccacaagttgcagttttgcctctgggaacaggcaacgatctatccaatacattgggttggggtacaggttatgctggagaaattccagttgcgcaggttttgcgaaatgtaatggaagcagatggaattaaactagatcgatggaaagttcaagtaacaaataaaggatactacaacttaagaaaacccaaggaattcacaatgaacaactatttttctgttggacctgatgctctcatggctctcaattttcatgctcatcgtgagaaggcaccatctctgttttctagcagaattcttaataaggcggtttacttattctatggaaccaaagattgtttagtgcaagaatgtaaagatttgaataaaaaagttgagctagaactggatggtgagcgagtagcactgcccagcttggaaggtattatagttctgaacatcggatactggggcggtggctgcagactatgggaagggatgggggacgagacttaccctctagccaggcatgacgatggtctgctggaagtcgttggagtatatgggtctttccactgtgctcagattcaagtaaaactggctaatccttttcgaataggacaggcacatacagtgagggtaggtgaaatatagctgtaacaggctaatttgtcccaatccaattctaagctgttgatatgtaaaatatacatgctatacttttctttaaacagtggtttatggctcatgcagctggtcactgtacactagcggctagagtgggatgaggaagaaacagaaacatggctcaagatccatgagataaaacgttcacttgaaaaaagaattccttaatcaatgaataaaaacatattcagattaatattttctaaaaatgaaatgcataagggttaagggattgtggatggtattattaaggaagacctttctaaatttggggggactgacttttaaacattatttgttccctaatatcagctgattttgaagtgctccatgatgccaatgcaggtggatggggagccttgggcccaagggccctgcactgtcaccataactcacaagacacatgcaatgatgttatatttctctggagaacaaacagatgatgacatctctagtacttcggatcaagaagatataaaggcgactgaatagatggatgagggagtgaaaactttgcatagaatcctcacgcaagtagatacatgttcatccaaaagtattaatagaaattctctatcagctattcagtcttaatttcactagtagtataatgggtatacatttttgtaaatagcatccccaaaccagccagccttcagttatttacaaatgtttgttcttttttcagcaaaatacttcaaatgaatagtattaacttacaaaaagtcacaaaaacttacatgagagtgaaaatttgttatgactgttttgagagtgggactcactctgaagtatgtgctgtctcatgtcttatttttgaaccatgcatatgatggacacacaatggatggacacattatatctccaacaaggtgtgggtggaaagatcaaattaacctgcttttttgaaaggaaatgattactgtcaaaccagcatggttaattgtgagcatcctcctgcagcatgccccttaagattttctacaacccaaaccaagtgtatgtattgatttctaggaacccccaaaaggagaatagtaaaaaaagatcatacttaaaatttgtattacaatttttattttaggaacttattcagacacgtaaatgttgtttaattctgtaggtaaccatttgagctgcaattcaggatcttttttataacaccagtgtagccaaaagagaaacagataagtgaattggtaagaaataagattcagagcacttgggattgtaagttataggttctgagctgaactgtttatcagccgctctttttattaaaagacagtgtcaacacttcaaaaaacgtgcttaaaggagacaacggtgagattaattgcttagaaaaagctcaaggctgactgataagttttaaaaatttggtggtcttgtagtattttgaaatacagtagtcttttaacagaatttccccttagggaggtaagtggacagaaatctttgctaaaatgtttatatcatatttattttaaaatgagagagatatatttttaaattatttattatttaccttgtggtatggtacctgtgtttagtgtttacgttctgtagctttatttaataagttaaattgatcacataaattctgctagtcacaatcagatagaaatttagtctattaattaaaattctaatttaattctcctgacagaaatctagatattcttattcttcacaaatattcctcattgtattgaaaaatgaaggagggcatgaaaagcactagggaactacttttggataactgaaagctttgtttcattgttttatttgcccctcaattgccacaaacttactgaagggctagtttcatggttcccattagagggtgcttgttcgctgctgttgaccagcccaagggtcgtgacccacaggtcggctgacccagagggcatccagcctggtgtttttctgacacatggcccaggctttgtggtctttcatgacattaatctctgaaagatcagaatgtatcccccaaaataccattagctatctttgagggtctattatgaatctgtcatccatgaattgccataaacctaagtttgcctcacctcaggcccagaccatgttttcaaagagcaacttagtaatgtatacagtagtcagtacattttatgaaatactctattttgctaaattaacctcttgcagatctcctcaggtgatcttaaattctagtcttgagaaactttgtgagcagatctgttttcagcttctttatatacctttcatggtaagtaaccatggcagtgaggatggcagagttttgttttttttttttttaatgggccaatcatgttctgagtattatgaagtttatcctttcattcatgatcaaaattgttaaagacatcacattttataaatacactgttaaatccactttgctgtaggttatagtttacctgttatataattcgtagtgctaattgtagtagaagcaaatcaatttaggatgttggaacgaaaataatcacaataactaatacagctttttaattgtgaaaactacaattaaaaattataattttaataccaaccataatattacactgtatttagaacaggcttatgtaaaatgccctcatttatctaaataagttgattttttggttattgtaatctagtaaggtttttgcatcactactggtctgtcatgaagtttttctgctggcttattcacttatttagacttcatttagggaagctatttcagaataccatctcataaaatgtatcattatcttgtttttgcaaaattcacttactttttgggcacatttacccagcatttcaaataagtgtataggcatgtgccttgtttaagtacaatttataagacttcatgtttgcaagttacatattagggtagtgattgtttatattaccagggattctacactttaccaaaaaaaattgccataagattttcctgttccattttaaattgtcttgatatttaaaaaaataacttctacattctcaggaagaaatacatgaagtaaatcatatctccatgtctgtttccagatttctctaatctttttactatcccaatacattcctaattcctataaacgtagtggcttaaatactgaatacctggcagctcttaaagatcccttaggcagatgatgataattttcagtgtttcgtcatgtttaatagaaatcaaactgacttgtgttttaaaatacaagttgtctgctagtaaagttacatgatttaggtgtgttttaggttttctgcaacaattagctgtgaacccctaatgtagctaagtttatacaaattttataatcaaaattatttatttttatttttttagagtatgtcaaaaacatatagtgtttgctttgtgaaatacatttgcttagagttataaaatatactgtgactcagaaattgtaaagtcagtttgcgttgtaaaaatgaatactaccagcatgtcaaaagaaaaataatttacatttgtaatataaagtaaaattgtatttaatatatttattgaattttaaatttgcactaacttgaaaactttaaaggttatactaatttaatgattaatgtggacccaaatacataatttggccaaaaaagtcattagaatgggtaatggttttgtgtggttttccttcaaaatgataatattgaagcaagaaccagcattttatattgataatttttttaatatttctacccagttgaggacagtggaatataagtagatatatttaaaatatctagatattt

SEQ ID NO: 126639 - DNA, 1843 bp, Homo sapiens
  Payload ID: 4829
  Gene Symbol: DGKE
  Gene Name: diacylglycerol kinase, epsilon 64kDa
  Uniprot ID: P52429
  ENST ID: ENST00000572810
  CDS Start-End: 173-706
cgcggccccgcgcgccggatcggcgtgcgtgcggctggagccttaagcgtttcccccgcccggcttcatccctgctggcggcccagcgtcgttctcctcctgcgcgaggcggccaaggcctgctggcccggagccgcgcctccacccgcgcgaggtatcgtccttggagaagatggaagcggagaggcggccggcgccgggctcgccctccgagggcctgtttgcggacgggcacctgatcttgtggacgctgtgctcggtcctgctgccggtgttcatcaccttctggtgtagcctccagcggtcgcgccggcagctgcaccgcagggacatcttccgcaagagcaagcacgggtggcgcgacacggacctgttcagccagcccacctactgctgcgtgtgcgcgcagcacattctgcagggcgccttctgcgactgctgcgggctccgcgtggacgagggctgcctcaggaaggccgacaagcgcttccagtgcaaggagattatgctcaagaatgacaccaaggtcctggacgccatgccccaccactggatccggggcaacgtgcccctgtgcagttactgtatggtttgcaagcagcagtgtggctgtcaacccaagctttgcgattacaggtatggtcttcgtggacactcactgtcccagaatgcgccgtgggaatcaggatttcatagagtggtgtagaggcctgctttaatctctgctgatgacctaaactcattttgaggaaacaagctaataaataaacatccctgagtttgtgcaagcgtggcagctttgcagtagtcatttgctgagacgatgcatccagcctccactcctcagccagcctgcccttttgggtaataaaacttggctcctaacgttaatacagaggtttctaagtggtgcctgcttcatggccactgtatattttagcttttgttcctatcgattatctccttattttaaataaggaaaaatgaaatatggacaaattaacttttcccttcagccgcaaaactgatgggtcacaggttttgtactatgaatgtgcagtgaaaacaagtgtcattccaaggcagcacttttatgtcttttgctaatatagctgttggtaccatagcgaaatatactcaaaaagaacactgaaaggaatattccttttgacgcttggtctttcaggacatgtagaatcttagataagtgaccttgattaagccaagaatattttaatgtcttttatatacacactggacaacacatttttgtccttaaatattgtttgaaaataggtgaagatgtcctttgctgatgttggaaattggtaaaggagaatgctgctttgcaaatgatctattctaactcagttcacagttgagaaaattaaagcccgttaggtccactctggtaaaataggactggcctccaggatttccagctctggactaacacttagcctcctttgagccttaagtctggacatcttcattgtaatgggttttatttctgacaagtagaaaggcgcataaacatgcttaagaaatgaaataggcagtaaataggaagctgctttttaatttttttaattttttttgcagaaattctttcattagcatgaacgctattataatgtcaatacctgtttttaagtcttattttaaataattttacacattatcaaagaggcttaagaataaatgttcaaaataatgtattctagacaactacaaagttttgtaaccatgcatttttatttggtatctttaaaaattaaatgctgtccttctggcatcagtgagagccaagttagcagggactttaaataaatttcataatgaa

SEQ ID NO: 126640 - DNA, 711 bp, Homo sapiens
  Payload ID: 4829
  Gene Symbol: DGKE
  Gene Name: diacylglycerol kinase, epsilon 64kDa
  ENST ID: ENST00000570738
  CDS Start-End: 1-213
cactgtgctcagattcaagtaaaactggctaatccttttcgaataggacaggcacatacagtgagggtggatggggagccttgggcccaagggccctgcactgtcaccataactcacaagacacatgcaatgatgttatatttctctggagaacaaacagatgatgacatctctagtacttcggatcaagaagatataaaggcgactgaatagatggatgagggagtgaaaactttgcatagaatcctcacgcaagtagatacatgttcatccaaaagtattaatagaaattctctatcagctattcagtcttaatttcactagtagtataatgggtatacatttttgtaaatagcatccccaaaccagccagccttcagttatttacaaatgtttgttcttttttcagcaaaatacttcaaatgaatagtattaacttacaaaaagtcacaaaaacttacatgagagtgaaaatttgttatgactgttttgagagtgggactcactctgaagtatgtgctgtctcatgtcttatttttgaaccatgcatatgatggacacacaatggatggacacattatatctccaacaaggtgtgggtggaaagatcaaattaacctgcttttttgaaaggaaatgattactgtcaaaccagcatggttaattgtgagcatcctcctgcagcatgccccttaagattttctacaaccc

SEQ ID NO: 126641 - DNA, 17261 bp, Homo sapiens
  Payload ID: 4830
  Gene Symbol: DGKH
  Gene Name: diacylglycerol kinase, eta
  Uniprot ID: Q86XP1
  ENST ID: ENST00000261491
  CDS Start-End: 22-3516
tccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacgatgttcctgcctgaaatgtctttctttttcttgcatgtcacatctaatactgtaacactttaaatagctttcatgtcagttttaatgttaatgggatttaatttattactaaagtacatttttgttggttaagggcactgcacttttctgttttttaatgtgggattttgcgtaaatattctgtacctaagactttgtgaaagtgtgtctgtgccataatcaacaaatgatatacatcacatgcaagtcaattttatttcaatctatcataagcagtaggcgtgcacgttaagaaaattctctggatattttcataaaattacatgctcccttacctgacaaaacttgttacagctttccaaaccaaaatttccacattttgtttctaatttttaatttcaatttaataattatttaatattctatttgaatttataatatagtaaagtgttgatatccaggaattccctgaggtgtcaactgagatttatatactgacagataacccagactcacccgctctctacagtgacttctgacacgatcttccaaacagaagggatttaaattttttcttaagggctttatgttgttattattattatctcacttaattcttaattcttatcaggtggatattattttcctttttctaaaccactgtacttcagtgtagcttattattagaagtcaacattacaatgatcaaatctttgaaagccaaaggcatacgtatcaaaaagtcacaaaaatatccttaaataagctttctttagccattatataccaaaacattaattataatattttaaaatttgtatataagagaaataaacagggtactgactcagtggtgacaatttttatgaagtagcctgctaggtgcttaatagatatatatacacacagatatatacatatacacatatatgtgtatatatacatacatacacatatacatttatatgtgtatatatatacctacatacatataaccttgtgatatggcatcattgatattttctagacaattatttccccagtgtttaaagagaaatactaataggcgagcatttaaaatgaactattgtcaggcatattatttaattacatcaaaggagtttaactgtttgacactttactcttgtttataacttgggtatttaactactagtaaaaatcacaaaattttaatgtctttaaaataaatgaccctgagggattcctgaccaagtatgtctgactatatattttacctaagttgtaaataaatggaaattttccaaagacagttatatcaagtagtttaaaaagtcatgaggcagggtgctgtggctcacgcctgtaatcccagcacttcgggaggtttaggtgggtagatcaccggaggtcaggagttcgagaccagcctgaccagtgtatgaaaccccatctctactaaaaatacaaaaattagccgggtgtggtggcacgcacctgtaatcccagctactcgggaggctgaggcaggagaattgcttgaacccaggagatggaggttgcagtgactgagatcacaccactgcactctactagcctgggtgacagagcaagactcccatctcaatctcaaaaaaaaatagtcatgaattatgcaattattctaattgtatctgcacttacgaagtcagaggtctcctttttcagtccctctgatagtcccacctaagtgctgtcctgctcctgtgaacactttcctgtgcaaccaaacaggaggtgccaggttcccagaactctctaacattacagatctctgtccatctttactaaaaaaaggaaatgtgagggaaagaaggggaagaactctagcataaataatgtattaatataaatatctatattgattttcaccccccattcccctttgctaatagaaaagagtctagctatgatgtgtcccaaatttaagagtgtgatgtgaaggactgaatttttgtttgttcgtttggtgagcttttcactcgtaggtgacatcttttgtatatgctgtaaagtctcagttaatggaatcctacagtgcatttctggctagctcggttggtagagcgtgagtctcttaatggaatccttaattagctagaattttcctgcaaatggctttggatgagggaaattctataaaatgacaatttggatatactttttgttaaatgagagcaattttctctgtatgctttgtctatgcatggctgtgcagggcccaaatgacttcactgacacctgtttccaggagggggtcttcagagcctccttaggctcttgtcagtatcataaataattcctcttcttatagcggatggggttaccaaaaaaaataaaaagtagggaagagcttctccatgggatcagatcacagctttggggagtgggatggggcctctatgctttgatctatgcatgagctggggtgagaagttcccacctgcacctgactgcaatgactgtaatggctggaattgtcacctcttctccctgataggctcttcctcacctggaggatcggggctggtgggagggcagggaaggggaggccatcagccagaatgtattttctttcagttccatttcctgaggaagaacttgcttttaaaggaggaaagggacagaatcagacctaaataaaattcctgagtatgcaatatttctctttagtgtctcttcacctccctttctgagtttctttcctacatcctggctcttcattttcccaatgcccaatataatcatggttgctgaaattctcactgccttctactttcctttccccatcaattaacccactacaaaatgacccctttcatttctcgcttaagcatacatggtgggtcatttaactaagtgttaggaagaaaacaatttaaagacactaattttacagtttgcgttctgtaaaaggatacttgctggataatctaagtgaattgatggattaggtcatttgggattgtgatatatattgttcttgctgacaagaaatgacccatgaatgtctagatctatcctgtccaatattgtagctacatgtggctatctaaatttaaatgtaatttaattaagccaggcataatggcacaagcctgtaattccggtgactcaggaggcttaggagggaagatggcttcaggccaggagtttgagaccagcctcggcaacatagtgagaccctgtctctgaaaaaaaatttttttaactagctaggcatggtggcatgcgcctgtagtcccagctattctgaaggctgaggtgggaggattgcttgagaccaggagttcaaggctgcagtgagccatgatcatgctactgccctccagcctgggcagcagagcaagacccctactctttaaaaaaattaatttaattagaaactccatttctcagttgcactaactacatttcaagtgttcagtaaccatagtggacagtgcagatgtagaaaatttccatcactgcaaaaattctattggacagcactggtgcagatcattgctactcaaaatgtgatccatgggccagcagcatcaatattacctgggagcttacagaaatgcagaatttcaggcccactgcagatctaccgaatcaaaatcttcctttagcaaaatttctcaaacgattagcactggcctacatccattttatccttccttagctattagggatgtgaggtccgagggcttcaaaaggtccccggaatagcttgttccttcatccactgtgtcctattcattcttcagctaactccagcaatgagctgaaactcattcatcacccttgctgagttttcttctcaatccttattcctaattctggttctagatgagccctacctacccagtggttgtatttttgtagccagtgtgggacacaggagattggcagaccaacacagctagcctctctctagccctccctccacctctaagtcactaacaatccatgtttgttcagtttgttgacatgtggcatgttcatttgttcacaacttaatcacgggggacatttcagaaaaatgtgtactaagttaaaaccatgtttagtctcctacaacttgtacattttcattttctcttatcagtagattgtccttgttgacatagctcatgcatgaggacacatagcagtacacacacattgaatgaattgttagtcatgcaaaaaaagaaaaggaatgaaccaagatgattgcaagttaatctcatttaagccctctaaaaaggcatgctttgctagatttagatctgttttccttacactcacttatcttgatgttcacatggttaataattccttaaaatagtgcctgaagaataatatttcatattcttgacccccaaataacagtttacttaattttataagatttttcccaatgagacttattttcaggaatccttctcttaataacttttacatattgatataatgtaccaaaacacaattgcctagagatgctttagctaatttttattaataaagaggacaatatttttgtcttcatggaacttatttttaacaggaatcaaggaagaaaatattcatgcagagctatgacttagaaagttataggggctgccactatacagcacttctaaagtaaaacatcttctatctccaactgggctgtcaacatagtggactttcatgttctatggatatgaattctttaaggatgtagcccttaattaagctgtaaaaacaatgcatctctcaaccttgacatttaggatctctcctgtctgccccctctacgccccactccaattaactcatcctacatctctcagatgtaagttggataagagtgggtttgaagtttggtaatacaagtggcagttttaaaacaccaaattctttagatcagctgaaaagaagagtgagaattgaaaattcctccactagtaattgttagccaatagaatagcctcccagagcagtccccacagcacttggttgccatgggtttctctcctctcactgcctgccccagtgccatgatgtctggggcttgtctcttctatggcatcccctgattgacttttgtatagcaacctctgtgtcaagtcagtaatatgatgccattgtaataggaggccttcctaaagaagtaactgcaacttttaaaacgtgatgattattggtttttataatacacaaagcattaattttttcttatcttattttctctttattatttctttccaacttttgtttggagacatttatgttagaagaaaaactataaagttttatcattgtagagaacagagagatcaaagacagctggactgtacctgtttgtgtaattatttctgatatttttaggaaaagaagtttaacagagtaactcagactgagactgttaaactctgttcatgataaactccatattacataatataggtgaacagattaattccctccatgtaactaagatactctatttacattatttatatactctcttagttttttatgcacttccaagttttagttggaaaaatgaaaaccaagctactacttaaaagttattaaaaacttcacataaaatatttcattttagctacaagttattcattgcataggattttataaatagtctgggtatttcataggaactgcatttcaaaagtgaattaaccaaacctaaaaaaagggttacttttaaaatgcattaaaataaagaagtttcatattcagttgataaggccattaaggtaggataatgcagttacatatacaaactaaaaaaggaaaaagaatatattttgtggtccttaatgtttgattgcactattgtttcccacagcttagccgtatctatttctgtataccaagtattaagctgatatgtagctaaatatttcttacagttctggtaactggtaactagtgctgtgaaaggttttggtattgtaacattcccagttttgtgagttatatattgtatattgaagatgactagtaaattcaagtaatatatttatctacagctgggaaaatataattattttcaaatcttcaagtaagttgtatcgaatgtttttcttcctcttaagtgagataaatctcacttttatgttaaaatgtctatttatacaacaggtttctccttttgctgttattttcatattaaaatttttcttatctttttatatcaaaataattatgctggctattcaaactgccaagatgtattttagtttgcaggatttttggcagacaaaatatttaataacaaatataaaagctttgtatattttgtggcattaggggcaagaattttacctttggatttctctatgtgaggcagtgctggtgtcagcaaagtcagtaacagacagtattacttgtaatcatcaaaagaaggtttccacaagttgtataaatcagtgcatttatttattatgttgtgaaacttaagctttatatgaaatacatattctagctcttttcctttttactgctgttgtttagagtgtgtagttctgttgatgatttacttatgtacttgaagtactcatttctgtcaaacagatgcccaactattttccttttaaaaaactgtattctttactgcaatagatagcggaatagtaatagacactttgttaaaaaaataagtttcatgtttaaaataaatatttttttaaaatataaagccaaaatgaattcaccaatattaaggatttaatgtagccaagggattcagtgtgttatattttgccaatatgtattttatcttcatgtcacaacttattttctgtagccaattctcagttttagttgaagagagatctcagtgattgtactgccaatatgacattcaaatgaacattaggaatcttgaaccatggctgagcgctgttgctcaggcctgtaatcccagcactttggaaagccgagggaggtagatcacctgaggtcaggagtttgagaccagcctggccaacttaatacaaaaattagccaggtgtggtggtgggtgcctgtaatcccagctactcaggaggctgaggcaggagaattgcttgaacccaggaggtggaggttgcagtgagccaagatctcgccactgcactccagcctgggcgacagagcgagactctgtctcagggggaaaaaaaagaattttgaaccccccaaaatatcacatatctagcagttctaggttccagggtggatatttttaacatatgtttgcatttggttctgggatagtaaccgttatggataattgtttgtttctgtcaagtcggtgagattttaattgtttgaattatttctatttaaaattactctcaatttaactgtttaaaaaactaaaaatttaaaacataatggcacaacatacgacacagaataaaacacatgttttcaaggaagaagaaaaaactgttttgacttaatgtgaagcaggggtttaccaaagaaaattgctttaataagccctaactttaactgttttcttctatgttacagtgttagcggttgatgtattgtgtactgtttaagaactcataggagactaataattaatttactataattttaaaggcaaagagttttatattaattttactgttgcacaagcagttattggaagtgggggaaaaaaagaaaactggtgagagaaattacatggaaattataggaaaaaggaacttgaattggtaatttggcaaagatttgggaacaaatagtttgaacatagatttctttcaccttatatgatagaaacacaaggcacacgtgagctgtatagtgtgctgagcacacccccagaaaacaaaaaatatcacattgatgaagtccgagactgtatctagatcttagcataactagtgaattcagggagcacatcctgctgctgaaattgagaagtcagtaagaaggtagttcagatgacctaatcattcaagacatttgatggagtccacacaagggtttatgatgtggggcaaatatctgtgctttctcatctcagtgattgatgtctggagaactagtcagacacacttagctggttcctatagaaaaacaccagtaaatgtggatcagaccataccctgcagaccaaggagattttcttaaacttgctaagcctttcttaaacttgccaagtattagcaatgataattgctaaatggattttttcctttcactgaaacaacaaaacaattattgaaattcacaatacctagagatgggaacatggtttaggtttatccagttctgtaactgactttggcattggctcattgtgtcctttctacaagttatgttttggtgacttggtgtccccagttagaaatggcacacaatattatcagttgttagtacttggtaacgtttcttttactaaaggaattatataagtatgaatcatacctaattttacaatttctttcccacggtcattttggatataaagatagacttcccagacagtgaggttagaaattagaagttcaaattgatatccctgatgtttaatttaaaaatgaaagtaaagttaaaattagtagcatttgtaccagagtagattatgggtattttcatctgttatattacatgttcatattattcattttaggataggccaaaactcacttctaaaatcttcaaaaattttgaatagtttcattttttcaatacttaagccaaatgacaattttatagatgtgaatatatgttttttaaagttaagtccttcatatcttttcttagtttaactccccaaagaggaaaatgtctctttaaaccagtagttaaaaagatggagtatgtgatgttcctttctctgtactgagttctgaatgtttaatccagagcatggatcactgactgcgttctctgactgtggaatggtattctttcatgcaaagtactttcaaaacttcccataaagaaactaaactagagattgtctttattaattaatggaactctgggtatgattaagggaattaaattagaaagtagaataacctagttaaaatcattatattagttatacatgagagtcagtgaacgatgacttgatttttacatgacatttgaattctgtcactatctgattcttgacctaaaggtttctttgctaaatctgatatttattatagtataatatgataatttggagctcctgttgcatctcactgccccaaaaatgttggaatgccatatgatacagggaaaagattggagttcatcaccgtggaattttgatctgtcttaatgacacaacttaattttcatgatgatagatctctgaatgattaatccagaatgatttggtacagtgactggaagaaattgtttttctgggaatttgcttcccataatgacctgatatacaggtgaccttagtataattgaaattaattataattttaattagaacatgctctgtttacagattataattgcgcagcattttaaaaaaatatacataattatgaggatgagagaattgcaaacttgaacagttcttttgttttctctccttttacttgaaaagctttcagaaagcttttgaaagatgacacagttttcatagcaacagtatgcaaattaggtttttctgccaagaaactcataaactaaagtatggaataacacaaatgcttaatcttaatcttggctttggattttgtaagcaaaagcattttctgcatcaatttttttcagtatgcagttgcatatttcattttttgattatgtcaaaagttgaattctcattttatgctgtgtttctcattagttgcagtaaagtgttgatttcattgctgcctttcaggccttcatcatacaaaccctcaccatttttcactcctgtgcttttgccataggtttttttttgtttttggtttttttccagcaactagtttttctactttcactctttcccaccagagtggtctctctaaaacaaatttgctaaagttcttaagtaggctcttttttctctaaattacagaatagcaaactaactcctaagcaagatgagtcagtgtctatgaccttgcctctttcttcctttttagtatcctcaccaaccttccctctgttgacttttgtaatccaggaatttggaactacttatgacttagtgccttggcataatcacatgccatagatgaacatgttcaagactcagttcaaatttaactttctgtgaagccctacctgacttccctaggcaggtattttctccatgcctatagtatattgaaactttttctgttaaaataacataacatttcaattacacacacacaacctgtctcttccactgaacttctctctccccctttgtattctcagtgtctagctacacataataggactttgataaatatttttgaatgaaggtaatagaaaacccgaacttctctatatttgtgtactttcacaaacaaaggcttagaattccacatgaaagtccacatgaggtaagtgtgcattcatgagcatgtgtgcactctgggcaaaccaacagaagataaacagcaaggaagagcagttgttttgtgaaaaataatcatctgttagctgtaaatcagaaatattggccaaatcagaattcttgtttctaaaatgaggcttctaaaattttcacataactgccaaactcttatttgtaattcttaaatatgccctaaagatcatctttctcttttatagacatttagtgtatacagtccacataaatacatatactgattacctacagacaataatgagacttcagaaagaatcaaaagcaatagtgatggtggaatttttaaataatattcagctggggggaaatagactgagtttgtgtgatttcaggttatttagagttattaatgtaaacataagaaggcttgtgactcttatcaccctctatagaatataaagactaaaaataaaaactattacctctgggcctgtttttctttgggattagataaagcctttctaccatatcaccaaatactcataaaggctaacacagaaagcttttccaagttaataatttctaaaattaaatatcagggccaggtgtggtggctgacacctgtaatcccagcactttgggaggccgaagtgggtggattacctgaggtcaggagctcgagacaagtcaacatggtgaaacctcatctctgctaaaaatacaaaaactagccaggcatggtgatgcacacctgtaatcccagctactcgggaggctgaggcaggagaattgcttgaacccaggaggcggaggttgcagtgagctgagattgcaccactgcactccagcctgggcgacagagtgagactctgtctcaaaaaaaagaaaaaaaatcaaaataattgtaattaactgaaatgccctgttccttcattcacttgatagacttttctacctgctctatacttggcactcaattagattctggggatacagataaaataagacaaagctcccatctggtagagtccaagtttgttttcacagttatttttccacagtctgtttaaggtattaggaggacttttataaaccgagtgtttttcaggttacttcagagaggagtctccttccacccaaaaaaactaaccaaattattttatcataaagaggtaatcccatttttatgtccacaatttttacatttttgtatcagccaccaataattttgactgttttgtcaagtacatatttcatcaatcctatttccacagccgtacatgtgatcccagtgactgatagatctgtagaatgtgaactcacatttaaagtttattttgggaaggcatatatgccttttgatgacacacacaccaaaatatataagagctgtgcatggtaaacccacagtagaagggaaaaagtaatgctttctggtatacttcagaggctccatttgaagatgtgcgttgatgtttccttgattattttgaatgaggagtaggcggtaatatttaacaggtagcatacgtatctaagcatatagtaaatattactagtacttgtgtgccatgaggcactaatacataggtgaaacaaaaatatttttagttctaaaaaattctctagatatttatggatggttaggcaatagggttccttcatgagaaggaaaaaactgtatctttattgtcagtaagtgtggaaaaaaacccgacttgtatgtgtattcacagtttgataggcatattttgaagtcattgttttccatcagtattaagtatcatccatttctatgttctctagcaaaagaaaattcttagtgtgatacagctttactctttgtttgactttgtacaaggtccacaaaaggaggaggctcaaaagattggacactttaccctgacattcagcacattcattttatctttcgataaagataaccagaaatcatttgcctcttgtttattatcatgttgaaaacacaacagtatagttccttttgtcccttacattggaaaaggtattttaaatttagccttgccgtattatttatagttaggaatttactacattttggtagtctgttttgaaactaagcacttgtgtctgaaagatgcagataatatctatctatttattacacagtgggctctgtttgctgcagaaaagagtgaaacttttaactgcttagcacacttgccagtgaaatatacctgacagagcagaggttataactttggctctaattacttttagtaatggtaagacaacgtgagttttgtttgtttacatgctgtttacaatggcataattttaaaaatatatacaattgagatatttattgcctactattttaaagatgttttatgtgttttcacctttggaatatattgttacatttccttgtacagataattttggtggctttgttaatgtagctagtaatttttatgactactaagtgaccagttttcggtgccttttattgtgggatgcatgattatgtatttattgtacggaagtcactgacgtgtgtatttttgtactttgctgaaagtaatggttgatcctgatgtacatgatgatgaaagacatctttcccaaagggcactgccttgagatcatccttctcaaataaaaagaatgcatttgaagaaa

SEQ ID NO: 126642 - DNA, 4246 bp, Homo sapiens
  Payload ID: 4830
  Gene Symbol: DGKH
  Gene Name: diacylglycerol kinase, eta
  Uniprot ID: Q86XP1
  ENST ID: ENST00000337343
  CDS Start-End: 22-3684
tccccgcaggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgca

SEQ ID NO: 126643 - DNA, 4202 bp, Homo sapiens
  Payload ID: 4830
  Gene Symbol: DGKH
  Gene Name: diacylglycerol kinase, eta
  Uniprot ID: Q86XP1
  ENST ID: ENST00000379274
  CDS Start-End: 104-3598
ttttgaacgtcacaaggaagaaacggtgcccggcgcagcttgccctggagcgtagctggagtgcggctgagttttcgctccgctgaagccggagtcggagaggatggcaggggccggaggccagcaccaccctccgggcgccgctggaggagcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacgatg

SEQ ID NO: 126644 - DNA, 3957 bp, Homo sapiens
  Payload ID: 4830
  Gene Symbol: DGKH
  Gene Name: diacylglycerol kinase, eta
  Uniprot ID: Q86XP1
  ENST ID: ENST00000536612
  CDS Start-End: 90-3392
ggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaagaacacagtaggagaaaaaagagacaccaaagaaaatggtaaacatatggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacga

SEQ ID NO: 126645 - DNA, 777 bp, Homo sapiens
  Payload ID: 4830
  Gene Symbol: DGKH
  Gene Name: diacylglycerol kinase, eta
  ENST ID: ENST00000611224
  CDS Start-End: 1-189
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagggtttcatcatgttggccaggctggtcacttctgagctcaagtgatccgcccacctgggcctcccaaagtgctgggattacaggtgtgagccaccgcgcccagccgaaaacaatacaattgtgaagcagttctacaccatgttcgtagcagcgttattcataggagccaaaaagtggaagcaacccaactgttcactgatggatgaatggataaacaaaatgtggcacacacatataataatgggacattattcagccttgaactggagggaaattctgacaggtcactgtgaggtgaaaggtcgcattttcaggtgtcagggaatctttactgcaatttgctgacattattgaacaccaccacatttagcatattttcacataacaaaaaacactacatgtatgtacttaacattttatagggtcgatcttccttattcatggtttcagtatttgctaatttacctactcactaacatttatttgtgactccaaaatcaatacttgtatgtaatttttcacatgtgaaaaattggagttgcccaatgtgcacattcgcagctaaggttgaacctggctgtgctctgtcttcttgttttagctctcatgcaataaacaagcaccctttcatga

SEQ ID NO: 126646 - DNA, 3449 bp, Homo sapiens
  Payload ID: 4830
  Gene Symbol: DGKH
  Gene Name: diacylglycerol kinase, eta
  Uniprot ID: Q86XP1
  ENST ID: ENST00000628433
  CDS Start-End: 133-3387
attattagaaatctttagtcatctcattccctgtgagctgaaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 126647 - DNA, 3045 bp, Homo sapiens
  Payload ID: 4830
  Gene Symbol: DGKH
  Gene Name: diacylglycerol kinase, eta
  ENST ID: ENST00000626247
  CDS Start-End: 93-362
aaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaaggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 126648 - DNA, 3517 bp, Homo sapiens
  Payload ID: 4830
  Gene Symbol: DGKH
  Gene Name: diacylglycerol kinase, eta
  ENST ID: ENST00000627777
  CDS Start-End: 99-3185
gagctgaaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacctccaattgcactaaacagcaccgattccgatggtttctgtagagcaacattttcgttctgtgttagtcctctattggtttttgtcaattctaagagtggagataatcagggagtaaagttcctccgtcgctttaaacagttgctaaatccggctcaggtgtttgatttaatgaatggaggtcctcatttaggtttaagattatttcagaagtttgacaatttccggattcttgtttgtggaggcgatggaagtgtaggttgggttttgtcagaaatcgataagctcaacttgaataaacagtgtcagctgggagtgttgcctttgggtacaggaaatgaccttgcccgagttcttggctggggaggttcatatgacgatgacacccaacttcctcagatcctagagaaactggaacgagccagtaccaaaatgttggacaggtggagtataatgacatatgaactcaaattgccaccaaaagcttccctacttccaggacctccagaagcatctgaagaattttatatgacgatttatgaagactcagttgcaacgcatcttacaaaaatcctcaattctgatgaacatgcagtggtcatatcttctgccaagacgctatgtgaaactgtaaaggacttcgttgccaaagtagaaaagacgtatgacaaaaccttggaaaatgccgttgtagctgatgccgtggccagtaaatgttcagtcctaaacgagaagctcgaacaactgctgcaggctttgcacacagattcccaggctgcgcctgttctccctggcctcagccctctcattgtggaagaagatgctgtggaatcgtccagtgaagagtccctgggtgaaagcaaagagcagcttggggatgacgttacaaaaccttcctcccagaaagccgtcaaaccaagggaaatcatgttgcgggcaaatagtttaaagaaagcagtgaggcaagtcattgaggaagccggaaaagttatggatgacccgacagttcacccctgtgaaccagctaatcagtcctctgattatgacagcacagaaacagatgaatctaaggaggaagctaaagatgatggtgccaaagaatcaataactgttaaaactgcacctcggtctccagatgcccgggcaagttatggccattcccaaactgattctgtccctggtccagctgtggcagccagcaaagaaaacctccctgtgctcaataccagaataatctgcccaggtttaagagcaggactggctgcctcaattgctgggagttcgattatcaacaaaatgttactggcaaacattgatccttttggtgccacgccgtttattgacccggatctagattccgtagatggatattcagaaaaatgtgtcatgaacaattactttgggattggattagatgcaaaaatttcattagaatttaataataaaagagaggagcaccctgaaaaatgcaggagccgaactaaaaacttgatgtggtatggagtccttggaacccgggagttattacagagatcgtacaagaatttagaacaaagggttcaacttgagtgtgatgggcagtatattcctcttcccagcttgcaaggcatagccgtgttgaacattcccagctatgctggaggcactaacttttggggtggaactaaagaggatgatatatttgctgcaccatcctttgatgacaagatcctggaagttgtagcaatatttgatagcatgcaaatggcagtttcaagggtcattaaactgcagcatcatcgaatagcccagtgccgtacagtgaaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctgcactgccgctgcactctgttttgcatcttctttggccaacctttgctttgtaatgcattgagcatgtagaaattaagggggttttgctcttaactttggtagttcagaaatggggcacagaggaagttgctgcttggctggatctgctcaatttgggagagtacaaagatatcttcatccgtcatgacatcagaggggctgaacttttgcatctggaaaggcgagatcttaaggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagc

SEQ ID NO: 126649 - DNA, 5805 bp, Homo sapiens
  Payload ID: 4831
  Gene Symbol: DGKG
  Gene Name: diacylglycerol kinase, gamma 90kDa
  Uniprot ID: P49619
  ENST ID: ENST00000265022
  CDS Start-End: 541-2916
gccgcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgcccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgccgtcggtgggcacttgttattttccaggaaccttctcctggtgtctacatgtttgcttagaggcggctccaagagcccccagagctgcctgcatagcacaccttagatgtggtatttattttcttagttctgtgaacacctgggagggagagcggagaaactgggatttatttttcaaattggtgtcataatattgtgtaaaaagggaaggaaaaaaaaaaccacccccagcttctttctttttcaagccaaagcgtgtttcctgtttgagttccaagccctggtggcagactattcctgaaggcagaaaagatgggaaggaaggaactttgctggggaaaccaggagacggttccctcctgcttctttgcactcaccactcccagagtatgacctgaaggaccttctgatggtcttaacgtgtgtgcgcgcgtgtgtgtgtgtgtgtgcgtgtatatatatatatttagcctatatatttatatatatatatatataaatatttatttactgatggacttttcctcattggaaaaaaaaaacataggtagtatgagacagaaagtggtaaggaaaaagaaggttctcactcccccactccaccgtttcattgtcaggacgcatctccctgtggtgatcacaagggttaaggggaatgaaagtagctccctattatgaacgaagagaccgagaactcctattctggatcctcaaaacaagcatgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgtttctgaaactgaggcaggttcaggtttggggtcactgattctaagacatttacagaagttcgtgcatgtgtttcagccatgatccccaagattgaggctattgagacatggcactatcaacaggtgaaattgattctcagagactcacaggtctcatgaaggggcagtgcagaaaatggcccttacctgctgcaccctagtgcacaggacttgcaatgttgcttgagagacatatcccaagtccttcttagaggcatggagtataacaacttcagtggaattgcacttccagtttggtaaccttagtaaatcttgtgttgttgtttaatcgtgccttgcaaatcatcctttaaacactatgactgtggtttcttgtggtggagtccctcatcatagtgaccctcatagcaacctctgaggttagcagagaaggtattattatctcgatctcaatgaggagaacaaggcttaatgaggtttagtgacttctcaaagccacatggttagtcaggggagaacctaatcccttatttcttatcttattctgattctggccatgctacaaacatgttctcacctgccccccatgcttctaccccaacagcaataaaaactgtaaagcaggaa

SEQ ID NO: 126650 - DNA, 3445 bp, Homo sapiens
  Payload ID: 4831
  Gene Symbol: DGKG
  Gene Name: diacylglycerol kinase, gamma 90kDa
  Uniprot ID: P49619
  ENST ID: ENST00000344484
  CDS Start-End: 292-2592
ggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaaggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgccgtcggtgggcacttgttattttccaggaaccttctcctggtgtctacatgtttgcttagaggcggctccaagagcccccagagctgcctgcatagcacaccttagatgtggtatttattttcttagttctgtgaacacctgggagggagagcggagaaactgggatttatttttcaaattggtgtcataatattgtgtaaaaagggaaggaaaaaaaaaa

SEQ ID NO: 126651 - DNA, 3152 bp, Homo sapiens
  Payload ID: 4831
  Gene Symbol: DGKG
  Gene Name: diacylglycerol kinase, gamma 90kDa
  Uniprot ID: P49619
  ENST ID: ENST00000382164
  CDS Start-End: 261-2519
ttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgagtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgcc

SEQ ID NO: 126652 - DNA, 462 bp, Homo sapiens
  Payload ID: 4831
  Gene Symbol: DGKG
  Gene Name: diacylglycerol kinase, gamma 90kDa
  ENST ID: ENST00000437018
  CDS Start-End: 1-462
catattgcccagtacctggagtgggatcccacagagctgaggcctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgg

SEQ ID NO: 126653 - DNA, 3895 bp, Homo sapiens
  Payload ID: 4832
  Gene Symbol: DGKI
  Gene Name: diacylglycerol kinase, iota
  Uniprot ID: O75912
  ENST ID: ENST00000288490
  CDS Start-End: 2-3199
gatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 126654 - DNA, 12928 bp, Homo sapiens
  Payload ID: 4832
  Gene Symbol: DGKI
  Gene Name: diacylglycerol kinase, iota
  ENST ID: ENST00000453654
  CDS Start-End: 541-2745
cggccagaaggagaaggacgaagcgctggaggagaagctgaggaacttaactttccggaagcaggtctcgtacagaatctgcacccctagagcaaatagtctctgtcgactgtaaagctgaaggtttgaaaaggcagtgcgagtgagctggagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttaataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggtaagtcaaaaataaaagtaggtgtccaaggattttacttttggcgaaatctgacgtctcctgagcttattttcattttgtccttggacatagcatagtgcttccctaatgtttctacatatgaccatgaatgatagtgtctctacatttaatttaaaagtctaatggtgacattttgcttatctgagtcacatttcggtaacatatcatcattttgaaagtgcggctatgacgtgctatattaaacaggaacagcctttcagtggatggggattttattaccacagtctttccatagtcatttcaaaatcaaattgttggtgggaggatggattgggttgtgagtaatctacttccatatatcagcctcagaaatggaactatcctttggatattacaggagacactgcagcagattgtttccagaagctggaaaaatatgctccaggagaatttaatcactgggcttttgctgggggatttttagttggcgggactgtcaaggaaatgtgatgacagaaatataatccttaacacaaactggaatctggctttgaatggcatcttccattccctggattgagtcaaatgtttggccaagcagtcagttatctagctgttactgttgggatgaagaactctgttttcatcaactaccatctcacatttctctaaatacttccaagtagcccagagaaaatttagggtacaggtggctatgggccaatttctaaatagctccaattgaagacataaatctgtgttatgaaaaatgatgagttggtactgtaagattcctgatgcatttggaaattttttcaaaccaaaaaaaaaaaaggcattagagtcctgtgttattcatggagaccaatatttgatatatcgctttgaaaaaagcaagtaccactaggacttgggatttccaaaataaagtgagcagaataaccacatgtttaatggcttcaacattaaaccacctcctgtagcatgttttaaaaattggtcctgggctttggaaagagctaaggccttatggtctaggagtttccatctcagcttaagtatattgtatccctactattaggacatcaggaaagcaagtgatctagtcctggtctgaagtgccatgtaactttaacagacataaaaatatgtacctatagaaatatcatttctacaaagcctactgagacagcactgaagaggcagctagcttggctgactcctctgtgtttgtttctttgtgtcatggcactgactgctttgagattccatttttagatgtggttgatagaggaatggaaaatgaagagttattaaaagacaacattctgtaacctgaaaggtagtcatttttgcaagcttatattttaatattgtgcatttaacaaaatagaacacagttaaactgtgctttatcgtattcaaggacttcataaagaataagagagaagattagtaagccaagaatggaataaataccatgactaggaattttgctttcagagcttatgtttcctctgtagatgtgataaccaaaaaccagtgcaagttttgaaacataatttagctggcaaatgcacagtgatggaaattagtaatgactgatggagagccgtacatacctgttgctccttatcctttcagaatggctgctttggcagatctgcctgtgctgggagctactcaacatcacttcattttcatctggacctagtgagagtccctttgcctaacgaatttctgaaatttatttatttactagaccccttataatattcatggctttaaaaaatgacacagcatctttattttattacatgtcaattttattaataatatttaggggtttttttaaattataaaaatggcacatgctttttataaaatgttttaataccacagatgagtatcacatccacagtcaaggcatccctttgttctggtgttgtgtcccacttcccaaaaataaatacggttaacactgatgaacactgttgcttgtatgtgatgtcagaaataccccatccgttcatgcacaagtatgtatgtatatacgcatatacatttacacacatatatagacatttatttatatacacatgcaagtatgtatactatattcatgtatattgcataggtttagaaaagagcaaacattttaaaagcatgctgatcatttgtatatgtctagtgaacaccagtaggcaaagacaggttaaacagagaagttccatttatttttttgtttccaccattgctaggcttagatctgttatggcattactacaattgcacttagcattttctattacctgtgtcataaaattcatgaccaagagttcctgtaattgtttatgttgccttccatgaagcatgaaacctaccatagccccaagacttatctatgctatgtttgtatttcaagtaaaggagagttctttcctctgtgatgcttacaccactttacaaggctgtttgtaacactaacactcagtaggttgcctagtgatatttaattagggcaggctacttccgggaaggtgtaacttcagtgtagtatgggggtctgagcagcttgtcttccttccagaaggagtagctaatgaaatcactgagaacagcatattttattcaattatgctatttaaaaatgggactttgttaaaatggctcatcataaccatcaaataaaactactaattgttctatttaaatgaattatattcattttaggaaaagaagtagaaaaacatctaataaattagctttctgattaatctttaacacttatttaatataaaatggcttctgcctgcatcttaattgaaccacctttgaatctctcaactcctttcactctgaatctcatactcagctgattagaagtcctacaggtccttctctgccaggtctgtcagatcgacttggaccctacccttttctgtgtccccagtcatccattatctcttgtctctctaagttttgggccatagcggcagtcctgtccctgaactttctgcctactactgtcaataattttgtcacgcagttgcaaaaatcttccccagatattatgctcaaaatacatcaaaatgaaattaccctctgggacaagtataccttttactcaaaggacacatggatgtccactgaccttgatcatcttatagaattatggcaagcatgattctgaaaatctatcaggtttagcaaatatctgtcttagtcccatgagggtacacaatcacggctgctgcttcctcattcaacaatgtaagccacatgcctctttgacggcacctggaggactaggttatagattttacactgctgagggccatctttggttttacactgtctcctcacagcttaatgagaaacctgaaaataagaaccaagaaaagagtcatgcccttggacaacctcctctcccaggacactgagatttactgaccaggtcccagaaagaaagcagaaaaataattcttaggctcttgtagcatggattttaaaatagaaacgtgaaaattgaatggtatcttcataatgcatagactccagagtctatttacatatgtattcagttatgcatgtaatcatatgtccatgaatcaatcataagtgcatgtatttaatcattatttgaaaaatatttgtcactctgaggcaggcatcatactaaggatataacaatgaatgtaatagacaaaactcttgatttcatgaagctggcatctagaagaaaagacaaattccaatgtgataagtgcagtgcaggagaaccccagggtgtccagcatgggctggaaattcaaccaaggctttattgtaccagccactcattagccagcaatgttttggttcaatgaaaacataagtaggaagagaataatattttgcatttccattttactggagtcatagtagatttctaaaaatgtatctgaaactaagattttaaaacaagacttagaaacactattaaaatgaaagctaagactgatttattctagctctcaggatagaactaggaaaaataagcagagttttcagtgggttttgactaaatataaagaagatgaagtacaaataatatgtaatagtggagtggatatcacagttataaactttcagcctctgttagcatttaaacagaggatacctgaccactctgaggggtgttgtgattaggaatatgtgatttgagggggctaaaattagatgctgtgatttttcaaaagatattttttaatggctttgttgaatggcaggattttattttaaaaactcatgaaaatcttgatttttgatttgttaaactttgctttataactgagaattttaaaaatatctaggggaatggccgttagttatcatttaaaaaattttaaactaagcatgaatttaagagctagtcaaaagaaaacatactaaaaggtgtaatttaattaaaaatacttctggaagcttataaattttgatcagtattcttagtcattgtcaagtaaaattctattagaaatctgtcttactgtccatccaatataaaaaagtgctgtggtttgatattctaagagttaagtgtaatctagtataaccacagaagaaaattctgcctgtaaggtatttgggagccaagtaaatgtacatgaaaggcaatcatggaaaactctttggcttctgccaccagcgtggcaaccacaagggaggtcctacccatggaaataagaaaatagtgatccaagttttcacccaacttttgaaatttcaatattttgagccaaatgccttctgaaatgggaggctttgatagtgggaaatactgaaattatcttttccctcagacctttagtgaaacacacatatagttttcactctatgacagtataaacaactcaaatctatactgtttgttaagaacagtttcaagaattaaaaagtgctttagcgttatgatgtattgacatgtttgagcttcagttggggttcaaaacaaccccaacgaggtgaataatgcatataatacattttagatgaatgcactgaatctcagagcagtgaattcagcctgtgcagattcatatagcaaatgatagtgctgcagccagaactgggtctttagaaattacatattaacatgttttctaagtaagtcattttccatcattgccttcaaggatgttttatatcaattgttcagatttccataatatagaagttgcctccatgaaaaaaaaatgtttacctaagtttccacggaaagaatgagttagaaataagggagaatgtgaaatcaaaaagtcagagtttttgctgtcggagagaggcttgtcagcttgtacatagttcaagcaaagaaaagtctaatgtttgcataccagggtggatttcaagagaagaaattaacagtgagcgttaatggcttctttaacttatttgtgattctcagcatttaaaaaatgttagtcctatttttcttcctttgaagtcactattaggatgatataatttctgaatgctgcaacaaaaaatgttaaaaatggccctgacatccaagactctattgctctaagtttatgggtgggtatgcaagctaagtgttatgataatacatagtcatatacatagaggtttaatacacctatgggaaattccggcatatttgaagtagagaaaaacaaacaggcttgaaatgtccttcagttcagaatctcatactttacaagggacatttatgggcagattggtgaatatgtagaaggaggatgtttgatctggaaagaagacaaaattggattaggaataagaatatgtagaggagttaggttaagtaggactgttagtttcaaattctgcagggaagatgatttgtagaataaaataaggaaagaaaagagcagtaacacatgaaaaggagttagctttattacttataaggatttatttttcctaaacattgcatccagaaaaacagtttgggctttctgaaaaacagtgaagttgttatcactgtttcttctagtagttaagtgaagattgaacaactaactcagagatcaaaggcatatctttaattgtgagagatcttggactagaaaaactctgtgagattttcttggtttaaatgtctataattttagactggaacagaactcaatttgagcctatttttttcccccaggttcctgccaactagatagcaatgaaggcattttttaaaaaagcttccatcattgcaaatatatcccaaatcacttagcagcggggatttcatgaccctaaaaagttgccttgcttacacaaacacacctatgctttagtagaaacatatcttttttaggagatttgggaattggctagcatttttgccaattgttagccaatttaggagatttggaaattggctagcaattttgccaattgttagccaattcccaaatctcctaaaaaagatatgtttctactaaagcaaaaaggtcacagattcaggagtcaaagtgaaaacaaaggatttagtgttctttcccctacttactacccatttgttgtttgggatgtagagtcaggactggagaagagggtgggaaattctatatcctctgccaatacagaggcatggaggcactttctataactttgtgtcatgaaacaagacttaaccccatatcagtagactaatgtttctgtcatatttctgtctaggtggattacagttttaattgcccatcatcccttaattctgtaatacagcttgagttcctagatttcaggttgactgggtgagggaggaagtcacttgaggtaattttaagaaatgaatccatatccagagtcttgcagaaaagacctgcttctactccaccttctttcttgttctacttcttgcctctggtttgggggcataaaagaggggcagagttgtgaggaaaggaaaaaagattctcaaaagtagtacaataagaagaccctagtagtaacacaaattctcatggtaatctcaaacaactgatagtgttagcagatattgaaaatcaaactcaggaaacatacagaaagattaaatttgttcaaagtggcttcaaggggtattagttgtgaaaatttcagtttatgcagcatagaagaattagattgtgtgtggaacttgggggaagtagggtcagctaatagaagaactttttaatggagctttccaaaggacgaggtggtttttggaaggagtttgtccaacctcttataatacattatgcctgtccacaaacttgttctggtccctgataaagtttgaaaaaaataaggaatatttagggttttttcccacaaatctcaatatattcacttaaaaattcagagactgtgaccttgttattttgggtttaaatatacattttcctcttaaaaatgatagatatatgtttacaaattgtctttactcttcacttataaaacacacacatacagataggatagtcctgtcagtttaccctattttttgtttcaaatttataggtaatttcaaatttataggtgttggtgagatttatcacttttaagataccatctagccttgatatttgttgtaccttctatatgcaaccaaatggctcctgatctcctgatcttctggagatcaaagaatttttattcgccactctccccacccatcattggttggattgagactctaattacatacaagcataatttccaatgcaagtagaactttgatgctctccctgacttaccgattataagttgggaaagtttggattcttgccatcctggggaaggagatttagaactctcatagacaaaatattctaacacaacagaatattttgcaaaacacatctttgaaaagtcaggggccaaaatagtctcagcaaaggttagcttggctgttttttaaaattaccaatagttaagtgggcaaccatgaatctgaatattatacagaccaccactgactgaaactgaggaaaaccattcttgtgaaaaactaaggaatagaggacaatctcagttctaaaagaatgaatatatttgatttaatttgatttctgagtgggaaaacgttcccaggcatccagggtacccttggctgtgggtattccactcgcaaaggctacatctgtatgaagagttgcagtcacattataaagggctttttcatgatttctgattctgccctatcacatcccagagccatgcttttgcaaagctgccagctggcaggtggaatccataaacaagtagcagctgtggcagtagaaagattaaagttttatttccaggtaaaggaggattcagataatacgaagtggagggagggtgggtgggggggggggggtgggatgggaaagggaagaatgaagttttttgtaacaaagtcataaagtatttttccctaattttcttgcatttcctatttatataaagtatcttgatcactgtgttgcactacagagattttcaatggagttaatttgggagactgaactaatctctgaaaaagaaattgactagttacagttactttttggacactttttctgtattgtgaattgtgtggaaatgtacagaataaaaatgaagaaatgta

SEQ ID NO: 126655 - DNA, 4163 bp, Homo sapiens
  Payload ID: 4832
  Gene Symbol: DGKI
  Gene Name: diacylglycerol kinase, iota
  ENST ID: ENST00000424189
  CDS Start-End: 231-3467
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatattcatcaggtgcaaactgcggacctgcggcgagtgtctgctccccccggctccttcaccattccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 126656 - DNA, 4070 bp, Homo sapiens
  Payload ID: 4832
  Gene Symbol: DGKI
  Gene Name: diacylglycerol kinase, iota
  ENST ID: ENST00000446122
  CDS Start-End: 231-3374
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 126657 - DNA, 2799 bp, Homo sapiens
  Payload ID: 4832
  Gene Symbol: DGKI
  Gene Name: diacylglycerol kinase, iota
  ENST ID: ENST00000614521
  CDS Start-End: 1-2799
aggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttga

SEQ ID NO: 126658 - DNA, 7407 bp, Homo sapiens
  Payload ID: 4833
  Gene Symbol: DGKK
  Gene Name: diacylglycerol kinase, kappa
  Uniprot ID: Q5KSL6
  ENST ID: ENST00000611977
  CDS Start-End: 61-3876
gtactttagccttccaggcttagggactcaggctgcccagacctgaagcggtgtgcggccatggaccgcggagctgccgcagcccagggcactgccccgcctcaggatggagagcagcccgctgagtctccagagcctccgccgccttggccgccgccgccaccaccaccggctccgccgccggctccgccgctgctctccgaggcttcgccagaacccataccagagccctgtccagagcttgctccaggtccctgtccagaggcgacctcagaatcagccacagaactgtacacagaaccgaccccagaaccagccacagagccggcctcagaaccggccccagaacctgccacagagccggccccagaacctgccacagagccggccccagaaccggccccagaacctgccacagagtctgccccagagccgactccagaacctgccctagagtcggtcccagagccggccccagagctgactccagaagttgccccagagctggccccagagccgaccccagaacctgtgacagagctggccccagagttctgccctgaggcggctccagagttccgtccaagtccagcaccatgtctattgcaatgtccggtggacactcgagagagaggtctaaagacctcgccatcgccatcgccatcgccatcgcccagaacgccaatgtcgtggtccagaataaagaaaatattgaaggaaggacctatgctgaagaactgtaactctttcaagagatggaagcttagatattttctggttcaaggacagaagctctactttgcacaccatcccgcgtttgcacactttgaaacgattgatctgtctcaagccactgtggcagaaagcagctgtagaaacctttgccacagtttttgtgttattacaccacaacgaaaaatcactctggctgcacccaaccggaaagacatggaagaatggattaacatcataaaaaccatccaacagggagaaatttataagatacctgcagcagaaaacaacccttttcttgttggaatgcattgttggtactccagttacagccaccggacccagcactgcaatgtttgtcgagagagcattcctgccttatctagagatgccatcatctgtgaagtgtgcaaagtgaaatctcacagattgtgtgctttgagagcaagcaaagactgcaagtggaatacattgtctatcactgatgacctccttctgcctgcagatgaagtaaacatgccccatcaatgggtagaaggaaacatgcctgtcagctctcagtgtgcagtgtgtcatgagagctgtggcagttatcaaagacttcaagacttccgctgcctgtggtgtaattctacggtgcatgatgactgtaggagacggttttccaaggaatgttgcttcagaagccatcgctcatcagtcattcctcccactgctctaagcgaccccaaaggcgatggccaattagtagtatcttcagacttctggaatcttgattggtcatcagcctgttcatgtcccttgctcatcttcatcaactccaaaagtggcgatcatcaggggatcgtcttcctccgaaaattcaagcaataccttaacccatctcaagtgttcgacttattgaagggtggacctgaagcagggctgtctatgttcaagaactttgctcgctttcgcattctggtttgtggtggagatggcagcgtgagctgggtcttatctctgattgatgcctttggattacatgaaaagtgtcagttggcagtcatcccacttggaaccggcaatgatctggctcgtgttctgggctggggtgcattctggaacaaaagcaagtcacctctggacatcctcaacagagtggagcaggctagtgtgaggatcctagacagatggagtgtgatgattcgtgagactcccagacaaaccccgctgctaaaaggacaggttgaaatggatgtaccacgatttgaggctgctgccatccaacacttagaatctgcagccaccgagttgaacaaaatcctgaaggccaagtaccccacagagatgatcatcgcaaccagattcttgtgttcagctgtggaagattttgtggttgatattgtaaaggcctggggtcagataaaacagaacaacactgcaatagtgtctgtgattttgaaaagtgacttaatgtatgataggctcagtgtcctgatcgatgtcctggctgaggaggcagcagctacttctgctgaaaaaagtgctacagaatatgcagacagcagcaaggcagataggaagcccttcattcctcaaatagaccacatagccaagtgcaagttggagctggctacaaaggcccagagtctccagaaatccttgaaactcatcatatttcaagttgaacaagctctggatgaggaaagcagacagacaatatctgttaagaactttagttcaactttcttcctggaagatgacccagaagatattaaccagacaagcccacgacgccgttctcgtcgtggcactttgtcttctatatcttctctcaaaagtgaggacctggacaaccttaacttggatcacttacattttacacctgaatctatacgcttcaaagaaaaatgtgtcatgaacaactacttcggaattggactggatgctaaaatttctctggacttcaacaccagaagagatgaacacccagggcaatacaatagccgccttaagaacaagatgtggtatggccttctgggaaccaaagaacttttgcagcgctcttacaggaaactggaagaacgagtgcatttggagtgtgatggagaaaccatctccttgccaaacctgcaaggcattgtagtgctcaacattaccagctatgctggaggtatcaacttctggggaagcaacacagcaaccacggaatatgaggctcctgcaatcgatgatgggaaactggaggtggtggcaatctttggttctgtgcagatggcaatgtcccgtatcatcaacctgcatcatcatcgcattgcccagtgccatgaggtgatgataaccattgatggtgaagaaggtatcccagtgcaggtggatggggaggcctggattcagagaccaggccttatcaaaattagatacaagaacgctgcccagatgctgacaagagatcgggactttgagaactcaatgaaaatgtgggaatacaagcatactgaaattcaagctgcccctcaaccccagctggacttccaggactctcaagagagcctctctgacgaggagtatgcccagatgcagcacttagctcggcttgcagaaaacctcatcagcaaacttaatgacctgagcaagatccaccagcatgtgtctgtcctcatgggttctgtgaatgccagcgctaacatcctgaatgatatattttacggccaagacagtggcaatgagatgggtgcagcttcctgtattcccattgaaactctaagcagaaatgatgccgtagatgttacatttagtcttaaaggtctctacgatgacaccacagctttcctggatgaaaagctgctgagaagtgctgaggatgagactgcactacaaagcgccctggatgccatgaataaggagttcaaaaagctatctgagattgactggatgaatccaatctttgttccagaggaaaaatcttcggacactgacagtagaagcctcaggctgaaaattaagttccccaaattgggaaagaaaaaggtagaagaggaacgcaagcctaaatcaggccagagtgtccagagttttattggcaatttatggcaccgcagacatcgtgaagatgaagcagagggtgatgatcctctaacaccatcgagatctcaactgtagcccttgaaagctggaagaactcacaacattgagaattctactaaaaaaactctcaaaacctcaatacaggctagactaaatcatttcagaacaaacatgagcaccaccaagaaagaccctccaattcttttcactaatgcattttcctggacttaatctggtctccttagaggtttacatttcctcattggccaaaggttcttgttccgagttgtcttgttcagttctccttctctttgtgcatcttgagcaactacagtatttattgggataagctctttatgaatggcctgggatctataaaggattcaagggagttcacctcttcagggagttttggaatggttttctctgaccagcagagaaactatcaatgctaaggaatgaatgaaagacacacagactcccagggagatgaagagaagggggcaggcaggacagccagacttggttgtgtgtctctccgaatccctgccaactgcaacttgcaccttcaggagatctcttctagttggctcattaaaatgagaactagatcctgggggcttgtccactttcctgttaagatgaccatgtgaaatctctttttgtagatatggtaacctctctctctctctgcaaaccctttgcgtttttctatgtgtgcttgtatgtctgcatatgtccaggtggtgctctggtgggctcattggttggaactcacccctcatggcaaccatacaggctcccctcctgctgccttgatcctagcctgcatgcctccacggagtgtttgcctgcattcttgctggattttttaactaaatgttttgccgctgtgctgcagtatagattatgtatagagacataaagatgtatatatatatacatacgcatatatatttttaagagctgaaaatacaactcgacctctaagtgaccctataatttattgtgctaatccaggaatcccttcccactcccccttactctacataacaataacacatacacctctaccaactgccctatttcttggtggagcttctaaatcttttggtgcattttcagcgtcttagaggtggctgggatctatggcccagctgattctgacgcccccttaaaattctgagccaggccatggaaaggggaacaaaaacaccaatgccctaaagaaggggtttaagctggcatgctgcctttttttgctctatctgtcctagactcttcatcagcaactgtgcccttccccaataaaaagactatatggagcaaccaggccttgagctctgtgacttagatgcctgaactagggactgcctgacaattaagtcacagcctaggcccttccccacaagctccatcttggcctgatcttctggacaggctgttgggtcagtcctcaagtcaccttcaaatctcccatcttgcccttttcccttgagtacagaggggcattgaagtgatcagaaaaaacatgggcctggagaaatgaaggctagaagcctgtgctttcctgtggttcttcttgcaaatttctcatgaaaacaaactattcctaaatcgctccaaatactaattcacatttttcaaaaatgccttctcccagtcagggcaaatctaatcaaaccccaatgcccagagaggttctctctggtcagccttgcatcttcaccccacccttgactcatacctttagttaactgtcccttcccacttatcaagagaaaactggcctctccctacttctcagacaaacttagcgtgctcaattacctgattcagtccaatggctggttcattgaggtgcacaattcagattccaagcactggttctcaactctggaactccaccagcctaacccacttaaaccagccacctgtgctccacctccgcaggggtgaggagaaaaatattaacaaggggatagtccccaaatgtctgattgctgtgccaaactaagtcctagctctacaactagagaagaaagtcaatggaaaaagatgacagaaaacatttaaaacttatttaagcatcagaatgtgttagcttgttgtacatatttgagtagtgagtgtgctgttgttgtgtctttgactttctctgttattagtctttcttcccaggaggaggtattagatgaaatcagcaagctcactattgcagcctgacttggctcctctatggctgcatgcattgacacctgcacacacactcacagagtgggaaccaagttgcattttcttcagaagagctttttccgaaggggaaaatgtccaaatgagcaaatttaggactacagaaggaagtcctgggagaagatagctttatcttggcagtgactaagcagggctgtgtcttataattatttttatcactgatgatagtaaactgtaataagactccatctcttgtgcttactttgctgcaataattaggtctttgtgcacagtgatgctgctgttgctctgttgtgccatgtggattccctttcacctaccctgtcctcccactctgagtcagaatgatattgactgaaaccactagtatttggggctagagtcagctcatggagcacagttgatagatgacaaggcccaggagcaggtgtggcttgctcaatccctcagttacctcctaaattgctaagttaccagtagtttcccaaaaaggaagatagcttgccaagcacctgttcttgcatatgctcacttggaaacaaagcaagaagtgatgcctcaagggagttgtcttagctctgggagtgtgagctcctttaaggactttgttaaccacttgcagtaattaatacaattgcttgggtggtgggaccaaacaccaaatatccatctcaattatgttcagacatcattaagacccaaagctctagggtttggttgtatctttggtagcactttctgacgaattggttgggtaggcaattcctggccagaagaatagtggagaagaaaaagccgatacatttgaactgccaccaactgcttctggtgtcaatactataggaggtaaacagttatgggtccccttctccagaaaggccctgtgctgtgtccataagagcaggttaagaataagaaagagattttttaccttaataaaactgggccagaagaaacagtcagggtcaacgtcatcttccctcaggacacaaatggaagaatttttctttcacgagaggtggaaaataataccaaagcaaccaaacccattagcaccattccatcctatatgagaccttgcttggctatatgatttgtggaattgcatttgtctatttgtcagtgaatctgtaacccattgttgttttctgctctgtgttttttatttcctcagaggcccctgcaaataagcagcagggccaggggctggttgggggaggaagctggggtatttacatggtaacaggaaaaagcagaaaaaaaagatccacaaagtgtgcctattcctctccccccgccaaatggaacaccagtcctcaatgttaataaagtattgcttctttaaatattttaataaatggataaacataa

SEQ ID NO: 126659 - DNA, 4636 bp, Homo sapiens
  Payload ID: 4834
  Gene Symbol: DGKQ
  Gene Name: diacylglycerol kinase, theta 110kDa
  Uniprot ID: P52824
  ENST ID: ENST00000273814
  CDS Start-End: 75-2903
gtaccgggccgtggagcggcggctcctgtacccccggcgcggacctaaaggggctcgggccgctcgggccgggaatggcggcggcggccgagcccggggcccgcgcctggctgggcggcggctccccgcgccccggcagcccggcctgcagccccgtgctgggctcaggaggccgcgcgcgcccggggccggggccggggccgggacccgagcgggcgggcgtcagagccccgggccccgctgccgcgccgggacacagcttccggaaggtgacgctcaccaagcccaccttctgccacctctgctccgacttcatctgggggctggccggcttcctgtgcgacgtctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagctgcacctccacccagactgtgtgcccttcgcctgcagtgactgccgccagtgccaccaggatgggcaccaggatcacgacacccatcaccaccactggcgggaggggaacctgccctcgggagcgcgctgcgaggtctgcaggaagacgtgcggctcctctgacgtgctggccggcgtgcgctgcgagtggtgcggggtccaggcgcactccctctgctccgcggcgctggctcccgagtgtggcttcgggcgtctgcgctccctggtcctgcctcccgcgtgcgtgcgccttctgcccggcggcttcagcaagacgcagagcttccgcatcgtggaggccgcggagccgggcgaggggggcgacggcgccgacgggagcgctgccgtgggtccaggcagagagacacaggcaactccggagtccgggaagcaaacgctgaagatctttgatggcgacgacgcggtgagaagaagccagttccgcctcgtcacggtgtcccgcctggccggtgccgaggaggtgctggaggccgcactgcgggcccaccacatccccgaggaccctggccacctggagctgtgccggctgcccccttcctctcaggcctgtgacgcctgggctgggggcaaggctgggagtgctgtgatctcggaggagggcagaagccccgggtccggcgaggccacgccagaggcctgggtcatccgggctctgccgcgggcccaggaggtcctgaagatctaccctggctggctcaaggtgggcgtggcctacgtgtccgtgcgagtgaccccgaagagcacggcccgctctgtggtgctggaggtcctgccgctgctcggccgccaggccgagagtcccgagagcttccagctggtggaggtggcgatgggctgcaggcacgtccagcggacgatgctgatggacgaacagcccctgctggaccggctacaggacatccggcagatgtctgtgcggcaggtgagccagacgcggttctacgtggcagagagcagggatgtagccccgcacgtctccctgtttgttggcggcctgcctcccggcctgtctcccgaggagtacagcagcctgctgcatgaggccggggctaccaaagccaccgtggtgtccgtgagtcacatctactcctcccaaggcgcggtagtgttggacgttgcctgctttgcggaggccgagcggctgtacatgctgctgaaggacatggctgtgcggggccggctgctcactgccctggtgctccccgacctgctgcacgcgaagctgcccccagacagctgtcccctccttgtgttcgtgaaccccaagagtggaggcctcaagggccgagacctgctctgcagcttccggaagctactgaaccctcatcaggtcttcgacctgaccaacggaggtcctcttcccgggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaagatcgtgcagatgagtaactactgtggcattggcatcgacgcggagctgagcctggacttccaccaggcacgggaagaggagcctggcaagttcacaagcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgctgcgcctgcccctgagagcgatcctaggtaggggtggctggggcagcccaagggctcgagccatctctgctcccgccagccttgttttcaggtggtctggaggcagctccacgtccacacagtggccggccctgtggtcggacctggctacagccctgaccacagcatcttcccagtgacggagcgggacccgccctcatcccattggtgacacatgttggtgtcacagccctcatcccactggagactggtgtgcgggtggcagtgttaccccgtgtcccgggtgggcgcagggctctggatggtgagccctctgccctgtgggggcctggtcctctcctcaggggtgggcacccatccctctccccactgagccccttgagctggacagtgctggatgcaggccgtccaggtgggtctgatctcactttgtgcccctcgggccgtccccctggccagtccttaagagcagcaggctccctggtgtgtccctgccccagcagacacaggctgccagtccctccagcctcacctccccgccctgggcagcaggtgtgggcagcgtgtgaggctgccgggtggtggtgactggtgacttccttgtgttcagggaagggagaaggtgccttcccttgttttctggccttgttatatacagatggcagcttggatctcaggtacagctccaggggcaggcagtgcccagctggacctggtggccctttcctagtgcctctgcttggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagcccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcagccctcctgctcccacgcccccagacagcttggtggagggtcctgcatctgggccaggctggggtgcacccagccaaagacaaagctgcctccacgtgcccaaggattcagatggtgcactggccccgggaggagtctgaccaaaaatggagcccgctctgtggggaagccccgactcccccacgagaaacggtcccacggtgcggatctcccccttcccttgtggggcacagctggcctgggcctccaatcctgcggagctttcctgggtgtggctttgacctcagaagtggctctggtttggcctcaggagtgtggcctggcccagcctgctgcagcctcctggggggcccttgatgccactaatcccccgaccccccgcatctgccaaactgcacagacacacgcattgtaaggccgcttgtggcctccagcgtgcactcttgtttacgtcattgtcatcttcaagaccagtcctttgtgattagttttgcttcgcgagccctggtgtggactgtggtctgtatgaatcgtgtgtaactgtggtgaggggcttgtcctgtatgtgagtctgtacccaggtggggtctgtgccctgcacaccgggcccctctgtatttatcgctgcctgaatgcaacagtaatttatatccaggacaaatacagtctgggcgtcactatccta

SEQ ID NO: 126660 - DNA, 479 bp, Homo sapiens
  Payload ID: 4834
  Gene Symbol: DGKQ
  Gene Name: diacylglycerol kinase, theta 110kDa
  ENST ID: ENST00000515182
  CDS Start-End: 1-474
cccaagatcgtgcagatgagtaactactgtggcattggcatcgacgcggagctgagcctggacttccaccaggcacgggaagaggagcctggcaagttcacaagcagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgctgcgcctgcccctgagagcgatcctaggtaggggtg

SEQ ID NO: 126661 - DNA, 4362 bp, Homo sapiens
  Payload ID: 4834
  Gene Symbol: DGKQ
  Gene Name: diacylglycerol kinase, theta 110kDa
  ENST ID: ENST00000509465
  CDS Start-End: 1-2630
gccccgctgccgcgccgggacacagcttccggaaggtgacgctcaccaagcccaccttctgccacctctgctccgacttcatctgggggctggccggcttcctgtgcgacgtctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagctgcacctccacccagactgtgtgcccttcgcctgcagtgactgccgccagtgccaccaggatgggcaccaggatcacgacacccatcaccaccactggcgggaggggaacctgccctcgggagcgcgctgcgaggtctgcaggaagacgtgcggctcctctgacgtgctggccggcgtgcgctgcgagtggtgcggggtccaggcgcactccctctgctccgcggcgctggctcccgagtgtggcttcgggcgtctgcgctccctggtcctgcctcccgcgtgcgtgcgccttctgcccggcggcttcagcaagacgcagagcttccgcatcgtggaggccgcggagccgggcgaggggggcgacggcgccgacgggagcgctgccgtgggtccaggcagagagacacaggcaactccggagtccgggaagcaaacgctgaagatctttgatggcgacgacgcggtgagaagaagccagttccgcctcgtcacggtgtcccgcctggccggtgccgaggaggtgctggaggccgcactgcgggcccaccacatccccgaggaccctggccacctggagctgtgccggctgcccccttcctctcaggcctgtgacgcctgggctgggggcaaggctgggagtgctgtgatctcggaggagggcagaagccccgggtccggcgaggccacgccagaggcctgggtcatccgggctctgccgcgggcccaggaggtcctgaagatctaccctggctggctcaaggtgggcgtggcctacgtgtccgtgcgagtgaccccgaagagcacggcccgctctgtggtgctggaggtcctgccgctgctcggccgccaggccgagagtcccgagagcttccagctggtggaggtggcgatgggctgcaggcacgtccagcggacgatgctgatggacgaacagcccctgctggaccggctacaggacatccggcagatgtctgtgcggcaggtgagccagacgcggttctacgtggcagagagcagggatgtagccccgcacgtctccctgtttgttggcggcctgcctcccggcctgtctcccgaggagtacagcagcctgctgcatgaggccggggctaccaaaggcgcggtagtgttggacgttgcctgctttgcggaggccgagcggctgtacatgctgctgaaggacatggctgtgcggggccggctgctcactgccctggtgctccccgacctgctgcacgcgaagctgcccccagacagctgtcccctccttgtgttcgtgaaccccaagagtggaggcctcaagggccgagacctgctctgcagcttccggaagctactgaaccctcatcaggtcttcgacctgaccaacggaggtcctcttcccgggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaagatcgtgcagatgagtaactactgtggcattggcatcgacgcggagctgagcctggacttccaccaggcacgggaagaggagcctggcaagttcacaagcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgctgcgcctgcccctgagagcgatcctaggtaggggtggctggggcagcccaagggctcgagccatctctgctcccgccagccttgttttcaggtggtctggaggcagctccacgtccacacagtggccggccctgtggtcggacctggctacagccctgaccacagcatcttcccagtgacggagcgggacccgccctcatcccattggtgacacatgttggtgtcacagccctcatcccactggagactggtgtgcgggtggcagtgttaccccgtgtcccgggtgggcgcagggctctggatggtgagccctctgccctgtgggggcctggtcctctcctcaggggtgggcacccatccctctccccactgagccccttgagctggacagtgctggatgcaggccgtccaggtgggtctgatctcactttgtgcccctcgggccgtccccctggccagtccttaagagcagcaggctccctggtgtgtccctgccccagcagacacaggctgccagtccctccagcctcacctccccgccctgggcagcaggtgtgggcagcgtgtgaggctgccgggtggtggtgactggtgacttccttgtgttcagggaagggagaaggtgccttcccttgttttctggccttgttatatacagatggcagcttggatctcaggtacagctccaggggcaggcagtgcccagctggacctggtggccctttcctagtgcctctgcttggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagcccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcagccctcctgctcccacgcccccagacagcttggtggagggtcctgcatctgggccaggctggggtgcacccagccaaagacaaagctgcctccacgtgcccaaggattcagatggtgcactggccccgggaggagtctgaccaaaaatggagcccgctctgtggggaagccccgactcccccacgagaaacggtcccacggtgcggatctcccccttcccttgtggggcacagctggcctgggcctccaatcctgcggagctttcctgggtgtggctttgacctcagaagtggctctggtttggcctcaggagtgtggcctggcccagcctgctgcagcctcctggggggcccttgatgccactaatcccccgaccccccgcatctgccaaactgcacagacacacgcattgtaaggccgcttgtggcctccagcgtgcactcttgtttacgtcattgtcatcttcaagaccagtcctttgtgattagttttgcttcgcgagccctggtgtggactgtggtctgtatgaatcgtgtgtaactgtggtgaggggcttgtcctgtatgtgagtctgtacccaggtggggtctgtgccctgcacaccgggcccctctgtatttatcgctgcctgaatgcaacagtaatttatatccaggacaaatacagtctgggcgtcactatcct

SEQ ID NO: 126662 - DNA, 473 bp, Homo sapiens
  Payload ID: 4834
  Gene Symbol: DGKQ
  Gene Name: diacylglycerol kinase, theta 110kDa
  ENST ID: ENST00000510286
  CDS Start-End: 45-473
gagccccgcttccttgcgggcctcaggggctgctctgaggaccgatgactcggaaagcgctcagaagaacgcttcgcccgttggtgctattctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagctgcacctccacccagactgtgtgcccttcgcctgcagtgactgccgccagtgccaccaggatgggcaccaggatcacgacacccatcaccaccactggcgggaggggaacctgccctcgggagcgcgctgcgaggtctgcaggaagacgtgcggctcctctgacgtgctggccggcgtgcgctgcgagtggtgc

SEQ ID NO: 126663 - DNA, 3213 bp, Homo sapiens
  Payload ID: 4835
  Gene Symbol: DGKZ
  Gene Name: diacylglycerol kinase, zeta
  Uniprot ID: Q13574
  ENST ID: ENST00000318201
  CDS Start-End: 73-2793
gtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggc

SEQ ID NO: 126664 - DNA, 3816 bp, Homo sapiens
  Payload ID: 4835
  Gene Symbol: DGKZ
  Gene Name: diacylglycerol kinase, zeta
  Uniprot ID: Q13574
  ENST ID: ENST00000343674
  CDS Start-End: 372-3209
ggagagtgtctctaaggtgacactcgggtgcgcggcagcagcggcggttgcaggagctcgctctccgcccgggctccggctccgctccagccgtccggggggcgccgcggcgcgcagagcgcagcaccccgactccagccaggagcccccgcccccccggagcgcaggaggaccccggcccgcctctcccaggcgcagcgcccagcatctcgctgctcctgtcgtctaagcgtcggcgtcgctagggacctgcggaacccggcgctcccctccctccccgcctcgcgtccccggcccgggcggactggagactcgaacttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggcccaggtcgcgcagccctggcccgagggttcccggggcacggccgctgggcccccggtggaggagcgtttccgccagctgcacctacgaaagcaggtgtcttacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 126665 - DNA, 2862 bp, Homo sapiens
  Payload ID: 4835
  Gene Symbol: DGKZ
  Gene Name: diacylglycerol kinase, zeta
  Uniprot ID: Q13574
  ENST ID: ENST00000421244
  CDS Start-End: 73-2862
gtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtag

SEQ ID NO: 126666 - DNA, 3482 bp, Homo sapiens
  Payload ID: 4835
  Gene Symbol: DGKZ
  Gene Name: diacylglycerol kinase, zeta
  Uniprot ID: Q13574
  ENST ID: ENST00000456247
  CDS Start-End: 89-2875
gcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 126667 - DNA, 4086 bp, Homo sapiens
  Payload ID: 4835
  Gene Symbol: DGKZ
  Gene Name: diacylglycerol kinase, zeta
  Uniprot ID: Q13574
  ENST ID: ENST00000454345
  CDS Start-End: 126-3479
tgctagctctccaaactaggacttgctcagcagaggccgccagcccggagctggatccagagcccggccttggggaccccagctcccacctgcgccctgccttccagatcagccaaccgcctgccatggagactttctttaggagacatttccgggggaaggtgccaggccctggagaggggcagcagcggcccagcagcgtggggctgcccacaggcaaggcccggcgtcgctcccccgctgggcaggcctcctcctcactggcacagcggcgccgctccagcgcccagctccagggctgcctcctgagttgcggggtgagggcccagggttccagccgccggcgctccagcactgtgcccccttcctgcaacccccgcttcatcgtggataaggtgctcactccacagcctaccaccgtgggggcccagcttctgggtgcacccctgctgttgaccgggcttgtgggcatgaatgaggaggagggtgtccaggaggatgtggtagccgaggcatcgagcgccatccagccaggcaccaagacaccagggccacccccacctcggggcgcccagccgctgttgcccctaccccgctacctgcgccgagcctcctcccacctgctccccgcggatgccgtatatgaccacgctctctggggcctgcacggctactatcggcgcctcagccagcggcggccctcaggccagcaccctggccctgggggccgaagagcctcaggcaccaccgccggcaccatgctgcccacccgtgtgcgcccactgtcccgcaggcgccaggtagccctacggcgcaaggcggccggaccccaggcctggagcgccctgctcgcgaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 126668 - DNA, 592 bp, Homo sapiens
  Payload ID: 4835
  Gene Symbol: DGKZ
  Gene Name: diacylglycerol kinase, zeta
  ENST ID: ENST00000524869
  CDS Start-End: 1-592
ttcggaataagatgttctacgccgggacagctttctctgacttcctgatgggcagctccaaggacctggccaagcacatccgagtggtggtgagcggggccaggctgccgtgggtgggtgggccggaagggagggaggcggaggccacctggcacatgcacctcaacaccctccccgcccgcctccagtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccaga

SEQ ID NO: 126669 - DNA, 2692 bp, Homo sapiens
  Payload ID: 4835
  Gene Symbol: DGKZ
  Gene Name: diacylglycerol kinase, zeta
  ENST ID: ENST00000528615
  CDS Start-End: 406-2529
gggcaggatgagcgcaccgggggctggccacagtgccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacaataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctgga

SEQ ID NO: 126670 - DNA, 542 bp, Homo sapiens
  Payload ID: 4835
  Gene Symbol: DGKZ
  Gene Name: diacylglycerol kinase, zeta
  ENST ID: ENST00000525242
  CDS Start-End: 493-542
acaagctcatgggaaacaagaactgaggcatcggaatgaacctgagcatggtggcggggggctccgtggcacatgcatcccaccaagagaggtcatgcaatgcccgtgcatccttctgggtcagagagacctgggctccaattccagccctgccccttcctagttgggtaagaggctttcacttctgaccctgtttcctcacacggaaaatgcgagcgatgataccttatcaagaatgtggctgggaagattcaagaagataccagatgtcaacttcctgactcagagcacgggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgt

SEQ ID NO: 126671 - DNA, 496 bp, Homo sapiens
  Payload ID: 4835
  Gene Symbol: DGKZ
  Gene Name: diacylglycerol kinase, zeta
  ENST ID: ENST00000533376
  CDS Start-End: 138-302
gcgcgcggcgcggggcgggcggagcgagcgcgcgccatggaggtggcgggcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggca

SEQ ID NO: 126672 - DNA, 294 bp, Homo sapiens
  Payload ID: 4835
  Gene Symbol: DGKZ
  Gene Name: diacylglycerol kinase, zeta
  ENST ID: ENST00000524448
  CDS Start-End: 1-294
gagtcagcgacatatggggagcacatctggttcgagaccaacgtgtccggggacttctgctacgttggggagcagtactgtgtagccaggatgctgataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggca

SEQ ID NO: 126673 - DNA, 3118 bp, Homo sapiens
  Payload ID: 4835
  Gene Symbol: DGKZ
  Gene Name: diacylglycerol kinase, zeta
  Uniprot ID: Q13574
  ENST ID: ENST00000532868
  CDS Start-End: 144-2945
agctggccccagccagcggaaggcgcctatgagccctgagcctgtggtcctcagcttgggcggccagcggcctctagcaggcccccccctcgaccccacccccgtcaggaagtgccgaaagaggaagagagtcgccgggcaggatgagcgcaccgggggctggccacagtgccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagctcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagct

SEQ ID NO: 126674 - DNA, 3337 bp, Homo sapiens
  Payload ID: 4835
  Gene Symbol: DGKZ
  Gene Name: diacylglycerol kinase, zeta
  Uniprot ID: Q13574
  ENST ID: ENST00000527911
  CDS Start-End: 198-3002
ggcacttcctggagcggcggcggcagcggcttcccgggcacctgggcgtggggagcgggggcgcgcggcgcggggcgggcggagcgagcgcgcgccatggaggtggcgggcggcgcggagcgggcgtgctgagccccggccgccggcccggcatgggcgtctcccgcgggccctccgccggccggggctagggccggatggagccgcgggacggtagccccgaggcccggagcagcgactccgagtcggcttccgcctcgtccagcggctccgagcgcgacgccggtcccgagccggacaaggcgccgcggcgactcaacaagcggcgcttcccggggctgcggctcttcgggcacaggaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgcagaagtcagtgtctcgaagaaagtgcgcagcctgcaagattgtggtgcacacgccctgcatcgagcagctggagaagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacccctgctcccccagcggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggag

SEQ ID NO: 126675 - DNA, 3512 bp, Homo sapiens
  Payload ID: 4835
  Gene Symbol: DGKZ
  Gene Name: diacylglycerol kinase, zeta
  ENST ID: ENST00000524984
  CDS Start-End: 91-498
gccgggggaagctgcaatgaatcctcagctctgggcccagtggaggcgctggggacggaagaaggggagcggccggggtcactgaggcagatgtggcgctaccgctcctgggacgtgccacagatcccatcagaggcaccccagacacagaaagccatcaccaagtcgggcctccagcacctggccccccctccgcccacccctggggccccgtgcagcgagtcagagcggcagatccggagtacagtggactggagcgagtcagcgacatatggggagcacatctggttcgagaccaacgtgtccggggacttctgctacgttggggagcagtactgtgtagccaggatgctgaagtcagtgtctcgaagaaagtgcgcagcctgcaagattgtggtgcacacgccctgcatcgagcagctggagaaggactctcgtgacgatttgggggtatccccaccttgtgaggatgactctgggttgtcctggagggagtgaccacatacctgaccccgaagggaggttctgacattttggtggtcactgccatgtttcacagataaatttccgctgtaagccgtccttccgtgaatcaggctccaggaatgtccgcgagccaacctttgtacggcaccactgggtacacagacgacgccaggacggcaagtgtcggcactgtgggaagggattccagcagaagttcaccttccacagcaaggagattgtggccatcagctgctcgtggtgcaagcaggcataccacagcaaggtgtcctgcttcatgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccaccccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcgtgcgggggcgacggcacggtgggctggatcctctccaccctggaccagctacgcctgaagccgccaccccctgttgccatcctgcccctgggtactggcaacgacttggcccgaaccctcaactggggtgggggctacacagatgagcctgtgtccaagatcctctcccacgtggaggaggggaacgtggtacagctggaccgctgggacctccacgctgagcccaaccccgaggcagggcctgaggaccgagatgaaggcgccaccgaccggttgcccctggatgtcttcaacaactacttcagcctgggctttgacgcccacgtcaccctggagttccacgagtctcgagaggccaacccagagaaattcaacagccgctttcggaataagatgttctacgccgggacagctttctctgacttcctgatgggcagctccaaggacctggccaagcacatccgagtggtgtgtgatggaatggacttgactcccaagatccaggacctgaaaccccagtgtgttgttttcctgaacatccccaggtactgtgcgggcaccatgccctggggccaccctggggagcaccacgactttgagccccagcggcatgacgacggctacctcgaggtcattggcttcaccatgacgtcgttggccgcgctgcaggtgggcggacacggcgagcggctgacgcagtgtcgcgaggtggtgctcaccacatccaaggccatcccggtgcaggtggatggcgagccctgcaagcttgcagcctcacgcatccgcatcgccctgcgcaaccaggccaccatggtgcagaaggccaagcggcggagcgccgcccccctgcacagcgaccagcagccggtgccagagcagttgcgcatccaggtgagtcgcgtcagcatgcacgactatgaggccctgcactacgacaaggagcagctcaaggaggcctctgtgccgctgggcactgtggtggtcccaggagacagtgacctagagctctgccgtgcccacattgagagactccagcaggagcccgatggtgctggagccaagtccccgacatgccagaaactgtcccccaagtggtgcttcctggacgccaccactgccagccgcttctacaggatcgaccgagcccaggagcacctcaactatgtgactgagatcgcacaggatgagatttatatcctggaccctgagctgctgggggcatcggcccggcctgacctcccaacccccacttcccctctccccacctcaccctgctcacccacgccccggtcactgcaaggggatgctgcaccccctcaaggtgaagagctgattgaggctgccaagaggaacgacttctgtaagctccaggagctgcaccgagctgggggcgacctcatgcaccgagacgagcagagtcgcacgctcctgcaccacgcagtcagcactggcagcaaggatgtggtccgctacctgctggaccacgcccccccagagatccttgatgcggtggaggaaaacggggagacctgtttgcaccaagcagcggccctgggccagcgcaccatctgccactacatcgtggaggccggggcctcgctcatgaagacagaccagcagggcgacactccccggcagcgggctgagaaggctcaggacaccgagctggccgcctacctggagaaccggcagcactaccagatgatccagcgggaggaccaggagacggctgtgtagcgggccgcccacgggcagcaggagggacaatgcggccaggggacgagcgccttccttgcccacctcactgccacattccagtgggacggccacggggggacctaggccccagggaaagagccccatgccgccccctaaggagccgcccagacctagggctggactcaggagctgggggggcctcacctgttcccctgaggaccccgccggacccggaggctcacagggaacaagacacggctgggttggatatgcctttgccggggttctggggcagggcgctccctggccgcagcagatgccctcccaggagtggaggggctggagagggggaggccttcgggaagaggcttcctgggccccctggtcttcggccgggtccccagcccccgctcctgccccaccccacctcctccgggcttcctcccggaaactcagcgcctgctgcacttgcctgccctgccttgcttggcacccgctccggcgaccctccccgctcccctgtcatttcatcgcggactgtgcggcctgggggtggggggcgggactctcacggtgacatgtttacagctgggtgtgactcagtaaagtggatttttttttcttt

SEQ ID NO: 126676 - DNA, 5757 bp, Homo sapiens
  Payload ID: 4836
  Gene Symbol: DAGLA
  Gene Name: diacylglycerol lipase, alpha
  Uniprot ID: Q9Y4D2
  ENST ID: ENST00000257215
  CDS Start-End: 117-3245
atcggggccttggggagcccaggatggaggtggcggtcgcggcggcgggccgagccctgcggcgggcgggaggaggtgagcaccaggcccactgagcctctgcagagccaccagccatgcccgggatcgtggtgttccggcggcgctggtctgtgggcagtgatgacctcgtcctaccggccatcttcctctttctcctgcataccacctggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcagtacgtgctctacgtgcgcctggccatcctggtgatcgagttcatctacgccatcgtgggcatcgtctggctcactcagtactacacctcctgcaacgacctcactgccaagaatgtcaccctcggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggcaccgcttagaggagggtcaagccaccagctggtcgcgccggctcaaagtgttcctctgctgcacgcggacgaaggactcccagtcagatgcctactcagaaatcgcctacctctttgcggagttcttccgggaccttgacattgtgccatccgacatcattgctggcctggtgctgctccggcagcggcagcgggccaagcgcaacgccgtgctggacgaggcaaacaatgacatcttggccttcctgtctgggatgccggtgaccagaaacaccaagtacctcgacctcaagaattcacaagagatgctccgctacaaagaggtctgctactacatgctctttgccctggctgcctacgggtggcccatgtacctgatgcggaagcccgcctgcggcctctgccaactggctcggtcctgctcgtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtctatgaaacgcccttctacgtggcggtggaccatgacaagaagaaagtggtgatcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaatggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctgctgctgtgagcaggaggagcccacatactttgccatctggggcgacaacaaggccttcaatgaggtgatcatctcgccagccatgctgcatgagcacctgccctatgtggtcatggaggggctcaacaaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggagcaagtcccagtctgagatgagcctggagggcttctcggaggggcggctgctgtcgccagtggttgcggcggcggcccgccaggacccggtggagctgctgctgctgtctacccaggagcggctggcggcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccgtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagca

SEQ ID NO: 126677 - DNA, 5699 bp, Homo sapiens
  Payload ID: 4836
  Gene Symbol: DAGLA
  Gene Name: diacylglycerol lipase, alpha
  ENST ID: ENST00000540717
  CDS Start-End: 83-586
ggtcgcggcggcgggccgagccctgcggcgggcgggaggaggtgagcaccaggcccactgagcctctgcagagccaccagccatgcccgggatcgtggtgttccggcggcgctggtctgtgggcagtgatgacctcgtcctaccggccatcttcctctttctcctgcataccacctggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcaccatcctggtgatcgagttcatctacgccatcgtgggcatcgtctggctcactcagtactacacctcctgcaacgacctcactgccaagaatgtcaccctcggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggcaccgcttagaggagggtcaagccaccagctggtcgcgccggctcaaagtgttcctctgctgcacgcggacgaaggactcccagtcagatgcctactcagaaatcgcctacctctttgcggagttcttccgggaccttgacattgtgccatccgacatcattgctggcctggtgctgctccggcagcggcagcgggccaagcgcaacgccgtgctggacgaggcaaacaatgacatcttggccttcctgtctgggatgccggtgaccagaaacaccaagtacctcgacctcaagaattcacaagagatgctccgctacaaagaggtctgctactacatgctctttgccctggctgcctacgggtggcccatgtacctgatgcggaagcccgcctgcggcctctgccaactggctcggtcctgctcgtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtctatgaaacgcccttctacgtggcggtggaccatgacaagaagaaagtggtgatcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaatggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctgctgctgtgagcaggaggagcccacatactttgccatctggggcgacaacaaggccttcaatgaggtgatcatctcgccagccatgctgcatgagcacctgccctatgtggtcatggaggggctcaacaaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggagcaagtcccagtctgagatgagcctggagggcttctcggaggggcggctgctgtcgccagtggttgcggcggcggcccgccaggacccggtggagctgctgctgctgtctacccaggagcggctggcggcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccgtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagc

SEQ ID NO: 126678 - DNA, 2897 bp, Homo sapiens
  Payload ID: 4837
  Gene Symbol: DAGLB
  Gene Name: diacylglycerol lipase, beta
  Uniprot ID: Q8NCG7
  ENST ID: ENST00000297056
  CDS Start-End: 171-2189
agtgcgcttgcgccgatctcggcctcagcgtgagcatgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagtgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcaccata

SEQ ID NO: 126679 - DNA, 2044 bp, Homo sapiens
  Payload ID: 4837
  Gene Symbol: DAGLB
  Gene Name: diacylglycerol lipase, beta
  Uniprot ID: Q8NCG7
  ENST ID: ENST00000425398
  CDS Start-End: 93-1724
ataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcaggacacagatctggtgcccagcgacattgcggcgggcctcgccctgcttcatcagcaacaggacaatatcaggaacaaccaagagcctgcccaggtggtctgccatgccccagggagctcccagctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagtgagcacgctcaggtgataggacgactcctgagacccagcgaccgtggagacagcctcgggaagccctggcccgtggatggatcccttggctgtctgaggactgctccagaagtgcgggaatcca

SEQ ID NO: 126680 - DNA, 2385 bp, Homo sapiens
  Payload ID: 4837
  Gene Symbol: DAGLB
  Gene Name: diacylglycerol lipase, beta
  ENST ID: ENST00000436575
  CDS Start-End: 253-2148
agttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagtgagcacgctcaggtgataggacgactcctgagacccagcga

SEQ ID NO: 126681 - DNA, 558 bp, Homo sapiens
  Payload ID: 4837
  Gene Symbol: DAGLB
  Gene Name: diacylglycerol lipase, beta
  ENST ID: ENST00000432248
  CDS Start-End: 111-558
gtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagctgcagaagcagaaccacagactatgact

SEQ ID NO: 126682 - DNA, 1374 bp, Homo sapiens
  Payload ID: 4837
  Gene Symbol: DAGLB
  Gene Name: diacylglycerol lipase, beta
  ENST ID: ENST00000454738
  CDS Start-End: 91-609
aatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggacacagatctggtgcccagcgacattgcggcgggcctcgccctgcttcatcagcaacaggacaatatcaggaacaaccaagagcctgcccaggtggtctgccatgccccagggagctcccagctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggaggtgagcctttgttttcctgctctaacagcttgctacttacaagtcatgtggtcaagactcatcttttttttcttttattttcctgagatgaagtcttgctctgtcgcccaggctggagtgcagtggcgtgatctcggctcactgcaagctccacctcccaggttcaggcggttcttctgcctcagcctcccgagttgctgggactacagacacccgccagcatgccggctaatttttgtatttttagtagtggtggggtttcaccatgttggccaggctggtcttgatctcctgacctcaagtgatctgcccgcctcggcctcccaaagtgcagggattacaggcgtgagccaccgcacccagctgagcaaagctctgcaggaatattctcagagcttcatcgtgtcactcgtcct

SEQ ID NO: 126683 - DNA, 1473 bp, Homo sapiens
  Payload ID: 4838
  Gene Symbol: DGAT1
  Gene Name: diacylglycerol O-acyltransferase 1
  ENST ID: ENST00000332324
  CDS Start-End: 275-1222
aggccccgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccg

SEQ ID NO: 126684 - DNA, 3711 bp, Homo sapiens
  Payload ID: 4838
  Gene Symbol: DGAT1
  Gene Name: diacylglycerol O-acyltransferase 1
  Uniprot ID: O75907
  ENST ID: ENST00000528718
  CDS Start-End: 275-1741
aggccccgcctcaggtcggccgcggactacaaatggacgagagaggcggccgtccattagttagcggctccggagcaacgcagccgttgtccttgaggccgacgggcccgacgcgggcgggttgaacgcgctggtgaggcggtcacccgggctacggcggccggcagggggcagtggcggccgttgtctagggcccggaggtggggccgcgcgcctcgggcgctacgaacccggcgggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtgacctcttcagcctgccaggggcctggggcctggtggggggtatggccacacccacaagggcgagtgccagagctgtgtggacagctgtcccaggacctgccggggagcagcagctccactgcagcagggcgggcatggccggtagggggagtgcaaggccaggcagacgcccccattccccacactcccctacctagaaaagctcagctcaggcgtcctctcctggtgctactcctgctgggtgtgcgggaatcggcactctggccctcagtgcaggatggtcaacttgcacccaccgtgctcagcttcagcttgggaagaggtcggccctgggtttgcgggaagtgggctccagccaggatggcccagggatgggcagtccacagggcctttctggtgtgggtctggtgagccgaggggctacggtacacaatggctatgtccatggctattcgccttggggcagggctcggtttggcagcctctttccttcacttggaacctgggcagccaggtgggctggtggctctcagctgccctccacgaggttggggcacccctgatccccaggcctgccttgccctctgctcttctggcaccaggctgggcagtgcagacagcgcagccctgcagccttcaggacaccttgttcccaggccctgcaatccaccaagctggatagatggggccccccttgatggtagcgggaggtcaggggtaaccccagggccctgctgctgccttaccttgctggggtgactgcttgattaaagaccccaagactggaccaggccctggtgtccccagacctgcagctatggcccaacaaggcaggtgtttgaggaggccctgcacagggtcccaggactgcaccaggggcctcatcagcaacctgctgaactggtggtgtgaggggagggtgggctcccttggtggtatcctccctctaccccagtgggggctggtgggccctgagatggaggcatctccttgggccctgctgaggatggcagtagtgggtgagctcctggtggggggatgggtgtggggccgactcctccatcccacatgggctcctgtgcctctccctatcagttggccagtggagctcgagaacaaactgttgctgccagataaagcagcaaagcctgctccactgcccagcgcaggcccccttcccttcctccaccaggctgagtggagaaccctaaagctacgggacaggctcccgttccccgtgcctacacagggtgctggctctggcagaaagacagtgtgcccgccccgcatcacctgtccgagtgcgaacaccttgggaagggggttcctggtggtcctgtgacaaccagagacccccagggccaaggtgaggcgcccacccctggtccctcaataaagaactgcaagcacatgctggtcctggggagtcgggcaggcacggagctagctgcaagcatccgtcttcccccaggaggccactgcagcccggcccttctgtgccctgggcccctcctcattgcagcaccacccaccgcaccaccctgggacagaggaaacacatggaggccatagcatagagcctgtctgtttatagatctctgcctgtcttgtccgtccatccactgtgtgtatatatctgtgtatctctgtggagcggggaacgggacagttgtgtaaaaatccaaaatacaattctgactatgaacaa

SEQ ID NO: 126685 - DNA, 2453 bp, Homo sapiens
  Payload ID: 4839
  Gene Symbol: DGAT2
  Gene Name: diacylglycerol O-acyltransferase 2
  Uniprot ID: Q96PD7
  ENST ID: ENST00000228027
  CDS Start-End: 261-1427
ctgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctc

SEQ ID NO: 126686 - DNA, 2324 bp, Homo sapiens
  Payload ID: 4839
  Gene Symbol: DGAT2
  Gene Name: diacylglycerol O-acyltransferase 2
  Uniprot ID: Q96PD7
  ENST ID: ENST00000376262
  CDS Start-End: 260-1297
tgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctct

SEQ ID NO: 126687 - DNA, 747 bp, Homo sapiens
  Payload ID: 4839
  Gene Symbol: DGAT2
  Gene Name: diacylglycerol O-acyltransferase 2
  ENST ID: ENST00000603276
  CDS Start-End: 268-747
ggaatctggagacaggggaccagtgaagaggatagtacagctgtctatgcaaggtggcatggcccaaggcagaagagagaaggagagaactgtttcctggttgttgggcatagaggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaag

SEQ ID NO: 126688 - DNA, 885 bp, Homo sapiens
  Payload ID: 4839
  Gene Symbol: DGAT2
  Gene Name: diacylglycerol O-acyltransferase 2
  ENST ID: ENST00000604733
  CDS Start-End: 1-885
ctcatagccgcctactccggggtcctgcgcggcgagcgtcaggccgaggctgaccggagccagcgctctcacggaggacctgcgctgtcgcgcgaggggtctgggagatggggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagccc

SEQ ID NO: 126689 - DNA, 618 bp, Homo sapiens
  Payload ID: 4839
  Gene Symbol: DGAT2
  Gene Name: diacylglycerol O-acyltransferase 2
  ENST ID: ENST00000604935
  CDS Start-End: 282-618
gagcgaggggaataaccgggcgcgccccttggaagcagggctcagagctgctctcctctcacgcattccccggatccgcgcggagcaggctgctggccagccccgggcccgcgccaagcagagcctcaggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgt

SEQ ID NO: 126690 - DNA, 584 bp, Homo sapiens
  Payload ID: 4839
  Gene Symbol: DGAT2
  Gene Name: diacylglycerol O-acyltransferase 2
  ENST ID: ENST00000605099
  CDS Start-End: 245-584
attgtgtatctatagaaaccagggcacaggggagcatgcagacagcccagagttacaaagccatgaggtggagggctaggatctgaacccaggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttga

SEQ ID NO: 126691 - DNA, 1553 bp, Homo sapiens
  Payload ID: 4840
  Gene Symbol: DGAT2L6
  Gene Name: diacylglycerol O-acyltransferase 2-like 6
  Uniprot ID: Q6ZPD8
  ENST ID: ENST00000333026
  CDS Start-End: 101-1114
cacagtaagagattatagcaaagcatctataatcaactcagcttaagaagttttgaccttctggttaggcttcttgccacaacagaacagcaccataaccatggctttcttctcccgactgaatctccaggagggcctccaaaccttctttgttttgcaatggatcccagtctatatatttttaggagctattcccattctccttataccctactttctgttattcagtaagttctggcccttggctgtgctctccttagcctggctcacctatgattggaacacccacagtcaaggtggcaggcgttcagcttgggtacgaaactggaccctatggaagtatttccgaaattacttcccagtaaagctggtgaagactcatgatctttctcccaaacacaactacatcattgccaatcacccccatggcattctctcttttggtgtcttcatcaactttgccactgaggccactggcattgctcggattttcccatccatcactccctttgtagggaccttagaaaggatattttggatcccaattgtgcgagaatatgtgatgtcaatgggtgtgtgccctgtgagtagctcagccttgaagtacttgctgacccagaaaggctcaggcaatgccgtggttattgtggtgggtggagctgctgaagctctcttgtgccgaccaggagcctccactctcttcctcaagcagcgtaaaggttttgtgaagatggcactgcaaacaggggcataccttgtcccttcatattcctttggtgagaacgaagttttcaatcaggagaccttccctgagggcacgtggttaaggttgttccaaaaaaccttccaggacacattcaaaaaaatcctgggactaaatttctgtaccttccatggccggggcttcactcgcggatcctggggcttcctgcctttcaatcggcccattaccactgttgttggggaaccccttccaattcccaggattaagaggccaaaccagaagacagtagacaagtatcacgcactctacatcagtgccctgcgcaagctctttgaccaacacaaagttgaatatggcctccctgagacccaagagctgacaattacataacaggagccacattccccattgatcaacccccaaagccatgagggatccaagtagagccacagaaaaagaagaattccaggagagggaaagatcgtaaggatgagagaggagaccatccaagccagaaattatttaataaatcagagttctagcaatagagtcctctcccaagtggctgaggcaggcttaggggaaagaaccagaggggcaggggaggactggggagggctggctagccagaggagttggctgtatcacccctggttattttagggcaacaacccagttggggagtcttatgaatcattccagccaactctctgatcacaaagaatactgtgcccctttctcctaaaccttagttcaccatcactacgtaggtttagacttagaagctttatttggaacagggatagtttgtttcctcttggtcctttcc

SEQ ID NO: 126692 - DNA, 5789 bp, Homo sapiens
  Payload ID: 4841
  Gene Symbol: DIAPH1
  Gene Name: diaphanous-related formin 1
  ENST ID: ENST00000253811
  CDS Start-End: 274-3960
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaattcccaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccatctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 126693 - DNA, 5795 bp, Homo sapiens
  Payload ID: 4841
  Gene Symbol: DIAPH1
  Gene Name: diaphanous-related formin 1
  Uniprot ID: O60610
  ENST ID: ENST00000389054
  CDS Start-End: 142-3960
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtactgcc

SEQ ID NO: 126694 - DNA, 5762 bp, Homo sapiens
  Payload ID: 4841
  Gene Symbol: DIAPH1
  Gene Name: diaphanous-related formin 1
  ENST ID: ENST00000389057
  CDS Start-End: 142-3933
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaccctgctagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 126695 - DNA, 5789 bp, Homo sapiens
  Payload ID: 4841
  Gene Symbol: DIAPH1
  Gene Name: diaphanous-related formin 1
  ENST ID: ENST00000398557
  CDS Start-End: 142-3960
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaccctgctagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 126696 - DNA, 2102 bp, Homo sapiens
  Payload ID: 4841
  Gene Symbol: DIAPH1
  Gene Name: diaphanous-related formin 1
  ENST ID: ENST00000448451
  CDS Start-End: 1-289
gcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagacaacctcttgtgcccctgggaagtagaggaggaggaggagacctttaaattgccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaat

SEQ ID NO: 126697 - DNA, 1180 bp, Homo sapiens
  Payload ID: 4841
  Gene Symbol: DIAPH1
  Gene Name: diaphanous-related formin 1
  ENST ID: ENST00000523100
  CDS Start-End: 86-691
aaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccg

SEQ ID NO: 126698 - DNA, 4668 bp, Homo sapiens
  Payload ID: 4841
  Gene Symbol: DIAPH1
  Gene Name: diaphanous-related formin 1
  Uniprot ID: O60610
  ENST ID: ENST00000518047
  CDS Start-End: 1-3792
atggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggag

SEQ ID NO: 126699 - DNA, 561 bp, Homo sapiens
  Payload ID: 4841
  Gene Symbol: DIAPH1
  Gene Name: diaphanous-related formin 1
  ENST ID: ENST00000524301
  CDS Start-End: 225-561
agaaatggcaggggagatcaagaacaatgtttcttctagtttaaagaggtttgaaatcttaatactttggtcctcttatctttgaacatagatgagagtacagagtcagtatggtaagttagataggaggaagactgatttcttcttttcatgtcagaagagtcttgaactgcttgtgaaccagaggaaccatgcctgtgtaagagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagt

SEQ ID NO: 126700 - DNA, 9333 bp, Homo sapiens
  Payload ID: 4842
  Gene Symbol: DIAPH2
  Gene Name: diaphanous-related formin 2
  Uniprot ID: O60879
  ENST ID: ENST00000324765
  CDS Start-End: 348-3653
gggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgtagaaaatactgtttctactcattcaaagcacattgtagatattcagagagaagaacaaatggctggcttggcaaatccccatctgagataaagtaaacaagtgaccagcagcccacagatgattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttaagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccatcatctcctttggctgctgtaacaaattaccaccaataatatgatggcttaacacaacagaaacttatttgcttacatttttgaagggcagcaaagccatgctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaattcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttatatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttacaatcattcagattgtgaattcaggctcagaatttacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcatgccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacagccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaa

SEQ ID NO: 126701 - DNA, 3782 bp, Homo sapiens
  Payload ID: 4842
  Gene Symbol: DIAPH2
  Gene Name: diaphanous-related formin 2
  ENST ID: ENST00000355827
  CDS Start-End: 397-3687
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccatctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgata

SEQ ID NO: 126702 - DNA, 3730 bp, Homo sapiens
  Payload ID: 4842
  Gene Symbol: DIAPH2
  Gene Name: diaphanous-related formin 2
  Uniprot ID: O60879
  ENST ID: ENST00000373049
  CDS Start-End: 348-3638
gggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatg

SEQ ID NO: 126703 - DNA, 3376 bp, Homo sapiens
  Payload ID: 4842
  Gene Symbol: DIAPH2
  Gene Name: diaphanous-related formin 2
  ENST ID: ENST00000373054
  CDS Start-End: 43-3354
agaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctatagttggaagtaaagttacgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccatctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaa

SEQ ID NO: 126704 - DNA, 4983 bp, Homo sapiens
  Payload ID: 4842
  Gene Symbol: DIAPH2
  Gene Name: diaphanous-related formin 2
  ENST ID: ENST00000373061
  CDS Start-End: 397-3702
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccatctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagtta

SEQ ID NO: 126705 - DNA, 3449 bp, Homo sapiens
  Payload ID: 4843
  Gene Symbol: DIAPH3
  Gene Name: diaphanous-related formin 3
  Uniprot ID: Q9NSV4
  ENST ID: ENST00000267215
  CDS Start-End: 1-3339
atggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatggtaataaaccgtatttataaattgcacattcttcttatctacttttatcctattgatctgtgattttagtagactgctgtgaaattctcaagttccaatataactaaaatagtaaaaatgtgtgcatgta

SEQ ID NO: 126706 - DNA, 3549 bp, Homo sapiens
  Payload ID: 4843
  Gene Symbol: DIAPH3
  Gene Name: diaphanous-related formin 3
  Uniprot ID: Q9NSV4
  ENST ID: ENST00000377908
  CDS Start-End: 1-3549
atggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataa

SEQ ID NO: 126707 - DNA, 3372 bp, Homo sapiens
  Payload ID: 4843
  Gene Symbol: DIAPH3
  Gene Name: diaphanous-related formin 3
  Uniprot ID: Q9NSV4
  ENST ID: ENST00000400319
  CDS Start-End: 1-3372
atggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttgaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataa

SEQ ID NO: 126708 - DNA, 3444 bp, Homo sapiens
  Payload ID: 4843
  Gene Symbol: DIAPH3
  Gene Name: diaphanous-related formin 3
  Uniprot ID: Q9NSV4
  ENST ID: ENST00000400320
  CDS Start-End: 1-3444
atggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatgggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataa

SEQ ID NO: 126709 - DNA, 4804 bp, Homo sapiens
  Payload ID: 4843
  Gene Symbol: DIAPH3
  Gene Name: diaphanous-related formin 3
  Uniprot ID: Q9NSV4
  ENST ID: ENST00000400324
  CDS Start-End: 222-3803
attgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatgaaaatcagaaagtgcagttgacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgattgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatgtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaaaa

SEQ ID NO: 126710 - DNA, 2735 bp, Homo sapiens
  Payload ID: 4843
  Gene Symbol: DIAPH3
  Gene Name: diaphanous-related formin 3
  Uniprot ID: Q9NSV4
  ENST ID: ENST00000465066
  CDS Start-End: 180-2729
ggaacctggcattgatcctcagtttagaacaggccagttaccatattgtccggagtgggtccttgacattcaggaaagatacatccttagacctttcaaaatttgtcatgcctctctaacctaaaacagccctcattaaatgcactttaatccgagcactgtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatggtaataaaccgtatttataaattgca

SEQ ID NO: 126711 - DNA, 2249 bp, Homo sapiens
  Payload ID: 4843
  Gene Symbol: DIAPH3
  Gene Name: diaphanous-related formin 3
  Uniprot ID: Q9NSV4
  ENST ID: ENST00000498416
  CDS Start-End: 149-2224
ggccagttaccatattgtccggagtgggtccttgacattcaggaaagatacatccttagacctttcaaaatttgtcatgcctctctaacctaaaacagccctcattaaatgcactttaatccgagcactgtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaaggtttgtgcctttttaagaaacatttcatggctctgatcttcagtgctaaaagactgaaaattataccttttatttgtatgtactttccactttctcacagtgttttcatacccaatatctcattttaaaaataaagagagttgtaggatatta

SEQ ID NO: 126712 - DNA, 714 bp, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENST ID: ENST00000311521
  CDS Start-End: 172-486
gtgcacagccaggctgcgaaggtgcagcgggcgggaggcccgttgggggctcagccggctgccagaagctctcgggctctttccttccgtgcccctcacttgctcatgggcccatgcctagccctgattcgttggacagagcctttgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataa

SEQ ID NO: 126713 - DNA, 637 bp, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENST ID: ENST00000355857
  CDS Start-End: 132-395
ggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataactttagtgatctga

SEQ ID NO: 126714 - DNA, 599 bp, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENST ID: ENST00000393103
  CDS Start-End: 244-510
ggaggggaccaacgggctccggcgctgacaccgcggcactcatgccctgtcccctttcagctgtttccagcatactgtgccccgtctgtcctcaggccagggcttcgctgcagccccggccactccctagtgcctggcccggtggtggccaggcagttggccgcgctgcttctcccgcagaggggacccccactgggggcgaaggcttggcctgccctcttcactgctgtatttccagacctgatgcctgcgtttgctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcg

SEQ ID NO: 126715 - DNA, 576 bp, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENST ID: ENST00000409094
  CDS Start-End: 99-413
gcgatcgcttcctggtcctcgcctcctccgctgtctccctggagttcttgcaagtcggccaggatgtctcagtgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgat

SEQ ID NO: 126716 - DNA, 740 bp, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENST ID: ENST00000535757
  CDS Start-End: 194-508
gctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggtacagcgcgtgcacagccaggctgcgaagtgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataacttt

SEQ ID NO: 126717 - DNA, 757 bp, Homo sapiens
  Payload ID: 4844
  Gene Symbol: DBI
  Gene Name: diazepam binding inhibitor (GABA receptor modulator, acyl-CoA binding protein)
  ENST ID: ENST00000542275
  CDS Start-End: 237-668
caggatgtctcaggtacagcgcgtgcacagccaggctgcgaaggtgcagcgggcgggaggcccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttggagagatgggggaaggggttgcacggattggaggagcgaggagactcagtccccatcccgaagcacagggcaggacgtcgcggcggagtggggaagcgaggagtccgtggccgagagcttggaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcg

SEQ ID NO: 126718 - DNA, 654 bp, Homo sapiens
  Payload ID: 4844
  Gene Symbol: DBI
  Gene Name: diazepam binding inhibitor (GABA receptor modulator, acyl-CoA binding protein)
  ENST ID: ENST00000535617
  CDS Start-End: 129-422
gctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggtacagcgcgtgcacagccaggctgcgaaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataacttt

SEQ ID NO: 126719 - DNA, 554 bp, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENST ID: ENST00000627093
  CDS Start-End: 76-465
agtgcaatctgggcgatcgcttcctggtcctcgcctcctccgctgtctccctggagttcttgcaagtcggccaggatgtctcagcacagggcaggacgtcgcggcggagtggggaagcgaggagtccgtggccgagagcttggaggtcaggggaagtacggggccggctgctcagagtgcgggacgaggagaatcgcggcccggggagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcg

SEQ ID NO: 126720 - DNA, 620 bp, Homo sapiens
  Payload ID: 4844
  Gene Symbol: DBI
  Gene Name: diazepam binding inhibitor (GABA receptor modulator, acyl-CoA binding protein)
  Uniprot ID: P07108
  ENST ID: ENST00000627305
  CDS Start-End: 85-531
tgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgagagcttggaggtcaggggaagtacggggccggctgctcagagtgcgggacgaggagaatcgcggcccggggagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcg

SEQ ID NO: 126721 - DNA, 887 bp, Homo sapiens
  Payload ID: 4845
  Gene Symbol: DCXR
  Gene Name: dicarbonyl/L-xylulose reductase
  Uniprot ID: Q7Z4W1
  ENST ID: ENST00000306869
  CDS Start-End: 51-785
agagcttcaagttccgcagccccagtgcggagggcggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccagactatgtgctattcctaggctg

SEQ ID NO: 126722 - DNA, 430 bp, Homo sapiens
  Payload ID: 4845
  Gene Symbol: DCXR
  Gene Name: dicarbonyl/L-xylulose reductase
  ENST ID: ENST00000579155
  CDS Start-End: 8-430
cgccgacatggagctgttcctcgcgggccgccgggtgctggtcaccggggcaggcaaaggtgggcggcggggaaagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcggg

SEQ ID NO: 126723 - DNA, 676 bp, Homo sapiens
  Payload ID: 4845
  Gene Symbol: DCXR
  Gene Name: dicarbonyl/L-xylulose reductase
  ENST ID: ENST00000582900
  CDS Start-End: 6-676
ccgacatggagctgttcctcgcgggccgccgggtgctggtcaccggggcaggcaaagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccg

SEQ ID NO: 126724 - DNA, 429 bp, Homo sapiens
  Payload ID: 4845
  Gene Symbol: DCXR
  Gene Name: dicarbonyl/L-xylulose reductase
  ENST ID: ENST00000577712
  CDS Start-End: 1-429
ggagctgttcctcgcgggccgccgggtgctggtcaccggggcaggcaaagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcag

SEQ ID NO: 126725 - DNA, 573 bp, Homo sapiens
  Payload ID: 4845
  Gene Symbol: DCXR
  Gene Name: dicarbonyl/L-xylulose reductase
  ENST ID: ENST00000577532
  CDS Start-End: 1-531
gtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctggtcccacagatgtacataaccgaggggcagagaaaacagtcgtgtatgcagaaataagtaggaagtgacgtttgccgattttgcttttaataacacaaattgtaagcttc

SEQ ID NO: 126726 - DNA, 341 bp, Homo sapiens
  Payload ID: 4845
  Gene Symbol: DCXR
  Gene Name: dicarbonyl/L-xylulose reductase
  ENST ID: ENST00000579004
  CDS Start-End: 1-260
tgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctggtgagtcagaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaga

SEQ ID NO: 126727 - DNA, 766 bp, Homo sapiens
  Payload ID: 4845
  Gene Symbol: DCXR
  Gene Name: dicarbonyl/L-xylulose reductase
  ENST ID: ENST00000581584
  CDS Start-End: 1-676
gctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctggtgagtcaggtgggagcccagccagcgtggtgccagcagtccctaggtagagcacgtggtgaacgccatcctctttctgctgagtgaccgaagtggcatgaccacgggttccactttgccggtggaagggggcttctggg

SEQ ID NO: 126728 - DNA, 452 bp, Homo sapiens
  Payload ID: 4845
  Gene Symbol: DCXR
  Gene Name: dicarbonyl/L-xylulose reductase
  ENST ID: ENST00000579821
  CDS Start-End: 1-301
gctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagctgtcccggtgtagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtga

SEQ ID NO: 126729 - DNA, 10277 bp, Homo sapiens
  Payload ID: 4846
  Gene Symbol: DICER1
  Gene Name: dicer 1, ribonuclease type III
  Uniprot ID: Q9UPY3
  ENST ID: ENST00000343455
  CDS Start-End: 239-6007
cggaggcgcggcgcaggctgctgcaggcccaggtgaatggagtaacctgacagcggggacgaggcgacggcgagcgcgaggaaatggcggcgggggcggcggcgccgggcggctccgggaggcctgggctgtgacgcgcgcgccggagcggggtccgatggttctcgaaggcccgcggcgccccgtgctgcagtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 126730 - DNA, 10220 bp, Homo sapiens
  Payload ID: 4846
  Gene Symbol: DICER1
  Gene Name: dicer 1, ribonuclease type III
  Uniprot ID: Q9UPY3
  ENST ID: ENST00000393063
  CDS Start-End: 183-5951
ggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttc

SEQ ID NO: 126731 - DNA, 607 bp, Homo sapiens
  Payload ID: 4846
  Gene Symbol: DICER1
  Gene Name: dicer 1, ribonuclease type III
  ENST ID: ENST00000531162
  CDS Start-End: 397-607
gtccgatggttctcgaaggcccgcggcgccccgtgctgcaggttacctagggtatgaattaatacagacttggaaactctgaaagaacttagaatcagcattttgagagcagaagcttgggcatgctgtgattttccaataaactgctatcacaatgtcaaaatgcagttcagacaagagcaacacagagatctcaaacattaaaacgtttcatagagtaatagcaatgaacactccaaagcagtgcaagagaggaaattcccttctgtggggcgaggaaatcctgctgacagtaaagccagtggtaggctttcacacagatatttgaatccctgaccctctgtttgaaggtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaaga

SEQ ID NO: 126732 - DNA, 498 bp, Homo sapiens
  Payload ID: 4846
  Gene Symbol: DICER1
  Gene Name: dicer 1, ribonuclease type III
  ENST ID: ENST00000529720
  CDS Start-End: 288-498
gtccgatggttctcgaaggcccgcggcgccccgtgctgcaggttacctagggtatgaattaatacagacttggaaactctgaaagaacttagaatcagcattttgagagttactactgggttatttggatttctcagccaaagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaaga

SEQ ID NO: 126733 - DNA, 6179 bp, Homo sapiens
  Payload ID: 4846
  Gene Symbol: DICER1
  Gene Name: dicer 1, ribonuclease type III
  Uniprot ID: Q9UPY3
  ENST ID: ENST00000527414
  CDS Start-End: 234-6002
gctggtttcatcctaaggctggatcttttcatgggtctgtgtagtgtaattgcagcagcaaatgggactaataatttcatgagtcatctttagagggaaagaaagacaactgcttctcttcaaccatcaaatgaaagtcctaaattttttgctgttggatgagcatgaaccaattcctctggccagggtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaa

SEQ ID NO: 126734 - DNA, 10331 bp, Homo sapiens
  Payload ID: 4846
  Gene Symbol: DICER1
  Gene Name: dicer 1, ribonuclease type III
  Uniprot ID: Q9UPY3
  ENST ID: ENST00000526495
  CDS Start-End: 293-6061
gcggaagtgggtgtttgttatttccccaaatgcggaggcccctgcaccactaacgcgaggaaacgcaggcgagtgggaaggttacctagggtatgaattaatacagacttggaaactctgaaagaacttagaatcagcattttgagagcagaagcttgggcatgctgtgattttccaataaactgctatcacaatgtcaaaatgcagttcagacaagagcaacacagagatctcaaacattaaaacgtaagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 126735 - DNA, 5621 bp, Homo sapiens
  Payload ID: 4846
  Gene Symbol: DICER1
  Gene Name: dicer 1, ribonuclease type III
  Uniprot ID: Q9UPY3
  ENST ID: ENST00000541352
  CDS Start-End: 10-5499
actggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctgcaaaccaggttgctcaacaagtgtcagctgtcagaactcattcagatctcaaggttggggaatactcaaacctagaagtaaatgcatcttggacaaaagagagatggaaccaagagtttactaagcaccaggttctcattatgacttgctatgtcgccttgaatgttttgaaaaatggttacttatcactgtcagacattaaccttttggtgtttgatgagtgtcatcttgcaatcctagaccacccctatcgagaaattatgaagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacagattgataaaggaagctggcaaacaagatccagagctggcttatatcagtagcaatttcataactggacatggcattgggaagaatcagcctcgcaacaaacagatggaagcagaattcagaaaacaggaagaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaatagatactgtgctagattaccaagtgatccgtttactcatctagctcctaaatgcagaacccgagagttgcctgatggtacattttattcaactctttatctgccaattaactcacctcttcgagcctccattgttggtccaccaatgagctgtgtacgattggctgaaagagttgtagctctcatttgctgtgagaaactgcacaaaattggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcaattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttgttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgc

SEQ ID NO: 126736 - DNA, 2776 bp, Homo sapiens
  Payload ID: 4846
  Gene Symbol: DICER1
  Gene Name: dicer 1, ribonuclease type III
  Uniprot ID: Q9UPY3
  ENST ID: ENST00000556045
  CDS Start-End: 284-2746
ctcaaccagccactgctggatgtggaccacacatcttcaagacttaatcttttgacacctcgacatttgaatcagaaggggaaagcgcttcctttaagcagtgctgagaagaggaaagccaaatgggaaagtctgcagaataaacagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactgattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaatagaaaagttttctgcaaatgtaccccgttcccctgtgcgagaattgcttgaaatggaaccagaaactgccaaatttagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaac

SEQ ID NO: 126737 - DNA, 1609 bp, Homo sapiens
  Payload ID: 4846
  Gene Symbol: DICER1
  Gene Name: dicer 1, ribonuclease type III
  ENST ID: ENST00000532939
  CDS Start-End: 1-1183
tttaaagcatgccatcaccacatatctattttgcacttaccctgatgcgcatgagggccgcctttcatatatgagaagcaaaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatgacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactggtaaggagcccacgaccagacttcatttctgggaaaatgagactttgtgttgatctcatcgtgttggccttgtaaaagtgatctatgcatgtacagtgttcatgcttaatattcaagggatggggcggggaacaaaaggaatagaaagaattcttttccttgttatttggggagcacgtattgctttataactttggttgttgggagtatggctatcatataccctcatcagtgtcattttatatctgcctaattagagaaattttaaccttagtattttgatgtgttttccccattttatcctccgcaaatatctttctcttgcccattcagtgctgcttttggtttttgatttagttgtatattctggatgtatttccacagccttttattgttcttcctggacaaaaagacccctcctttagggtctttttaaagatggatagattaaaagattaaaagcaatgatttcacaagaa

SEQ ID NO: 126738 - DNA, 1790 bp, Homo sapiens
  Payload ID: 4847
  Gene Symbol: DKK1
  Gene Name: dickkopf WNT signaling pathway inhibitor 1
  Uniprot ID: O94907
  ENST ID: ENST00000373970
  CDS Start-End: 140-940
ccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataataccta

SEQ ID NO: 126739 - DNA, 3638 bp, Homo sapiens
  Payload ID: 4848
  Gene Symbol: DKK2
  Gene Name: dickkopf WNT signaling pathway inhibitor 2
  Uniprot ID: Q9UBU2
  ENST ID: ENST00000285311
  CDS Start-End: 707-1486
gcgggagcccgcggcgagcgtagcgcaagtccgctccctaggcatcgctgcgctggcagcgattcgctgtctcttgtgagtcaggggacaacgcttcggggcaactgtgagtgcgcgtgtgggggacctcgattctcttcagatctcgaggattcggtccggggacgtctcctgatcccctactaaagcgcctgctaactttgaaaaggagcactgtgtcctgcaaagtttgacacataaaggataggaaaagagaggagagaaaagcaactgagttgaaggagaaggagctgatgcgggcctcctgatcaattaagaggagagttaaaccgccgagatcccggcgggaccaaggaggtgcggggcaagaaggaacggaagcggtgcgatccacagggctgggttttcttgcaccttgggtcacgcctccttggcgagaaagcgcctcgcatttgattgcttccagttattgcagaacttcctgtcctggtggagaagcgggtctcgcttgggttccgctaatttctgtcctgaggcgtgagactgagttcatagggtcctgggtccccgaaccaggaagggttgagggaacacaatctgcaagcccccgcgacccaagtgaggggccccgtgttggggtcctccctccctttgcattcccacccctccgggctttgcgtcttcctggggaccccctcgccgggagatggccgcgttgatgcggagcaaggattcgtcctgctgcctgctcctactggccgcggtgctgatggtggagagctcacagatcggcagttcgcgggccaaactcaactccatcaagtcctctctgggcggggagacgcctggtcaggccgccaatcgatctgcgggcatgtaccaaggactggcattcggcggcagtaagaagggcaaaaacctggggcaggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgcaacttgtctatgtaaataatgtacacatttgtggaaaatgctattattaagagaacaagcacacagtggaaattactgatgagtagcatgtgactttccaagagtttaggttgtgctggaggagaggtttccttcagattgctgattgcttatacaaataacctacatgccagatttctattcaacgttagagtttaacaaaatactcctagaataacttgttatacaataggttctaaaaataaaattgctaaacaagaaatgaaaacatggagcattgttaatttacaacagaaaattaccttttgatttgtaacactacttctgctgttcaatcaagagtcttggtagataagaaaaaaatcagtcaatatttccaaataattgcaaaataatggccagttgtttaggaaggcctttaggaagacaaataaataacaaacaaacagccacaaatacttttttttcaaaattttagttttacctgtaattaataagaactgatacaagacaaaaacagttccttcagattctacggaatgacagtatatctctctttatcctatgtgattcctgctctgaatgcattatattttccaaactatacccataaattgtgactagtaaaatacttacacagagcagaattttcacagatggcaaaaaaatttaaagatgtccaatatatgtgggaaaagagctaacagagagatcattatttcttaaagattggccataacctgtattttgatagaattagattggtaaatacatgtattcatacatactctgtggtaatagagacttgagctggatctgtactgcactggagtaagcaagaaaattgggaaaactttttcgtttgttcaggttttggcaacacatagatcatatgtctgaggcacaagttggctgttcatctttgaaaccaggggatgcacagtctaaatgaatatctgcatgggatttgctatcataatatttactatgcagatgaattcagtgtgaggtcctgtgtccgtactatcctcaaattatttattttatagtgctgagatcctcaaataatctcaatttcaggaggtttcacaaaatggactcctgaagtagacagagtagtgaggtttcattgccctctataagcttctgactagccaatggcatcatccaattttcttcccaaacctctgcagcatctgctttattgccaaagggctagtttcggttttctgcagccattgcggttaaaaaatataagtaggataacttgtaaaacctgcatattgctaatctatagacaccacagtttctaaattctttgaaaccactttactactttttttaaacttaactcagttctaaatactttgtctggagcacaaaacaataaaaggttatcttatagtcgtgactttaaacttttgtagaccacaattcactttttagttttcttttacttaaatcccatctgcagtctcaaatttaagttctcccagtagagattgagtttgagcctgtatatctattaaaaatttcaacttcccacatatatttactaagatgattaagacttacattttctgcacaggtctgcaaaaacaaaaattataaactagtccatccaagaaccaaagtttgtataaacaggttgctataagcttggtgaaatgaaaatggaacatttcaatcaaacatttcctatataacaattattatatttacaatttggtttctgcaatatttttcttatgtccacccttttaaaaattattatttgaagtaatttatttacaggaaatgttaatgagatgtattttcttatagagatatttcttacagaaagctttgtagcagaatatatttgcagctattgactttgtaatttaggaaaaatgtataataagataaaatctattaaatttttctcctctaaaaactgaa

SEQ ID NO: 126740 - DNA, 925 bp, Homo sapiens
  Payload ID: 4848
  Gene Symbol: DKK2
  Gene Name: dickkopf WNT signaling pathway inhibitor 2
  ENST ID: ENST00000513208
  CDS Start-End: 235-714
atcttgtctctgcaggaaaaggaaagaaaacacctggagatcctgcgtttggtggtgaccaagtatccttttgagacaataaaggaaataatgtataaccaggctgtgcagttattccacgtgtgaatatatcacctagcatgaccttgaggataggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgc

SEQ ID NO: 126741 - DNA, 908 bp, Homo sapiens
  Payload ID: 4848
  Gene Symbol: DKK2
  Gene Name: dickkopf WNT signaling pathway inhibitor 2
  ENST ID: ENST00000510463
  CDS Start-End: 258-899
gctatctggagagaaagagcatgttaaattagaaacagatgggaagaatgacacacatagctctggaattcacagtgcagggcggcagagttcagtcaggttcttgacatcctgacaatcttgtctctgcaggaaaaggaaagaaaacacctggagatcctgcgtttggtggtgaccaagtatccttttgagacaataaaggaaataatgtataaccaggctgtgcagttattccacgtgtgaatatatcacctagcatgaccttgaggatagattactgtcaaggcctcctggttggtgtctcttcctctggcctcaatatcatccaaatacaatgccaagcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattg

SEQ ID NO: 126742 - DNA, 2636 bp, Homo sapiens
  Payload ID: 4849
  Gene Symbol: DKK3
  Gene Name: dickkopf WNT signaling pathway inhibitor 3
  Uniprot ID: Q9UBP4
  ENST ID: ENST00000326932
  CDS Start-End: 226-1278
ggcggagagggagcctggtgggcgggcggggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 126743 - DNA, 2650 bp, Homo sapiens
  Payload ID: 4849
  Gene Symbol: DKK3
  Gene Name: dickkopf WNT signaling pathway inhibitor 3
  Uniprot ID: Q9UBP4
  ENST ID: ENST00000396505
  CDS Start-End: 240-1292
cgacgccaaggggagggggctgacctgtgcttggtccaccccaggtaggggctgagagaggcttgaggtggaagtgggggtcgggcactctgacctggtcgaggaggggctagggtttgaaccggggacagagtctaggtgagctggggcttgggagctattagcgtagaggatccgggttcggttgctctggcgagggctccagcatcacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 126744 - DNA, 521 bp, Homo sapiens
  Payload ID: 4849
  Gene Symbol: DKK3
  Gene Name: dickkopf WNT signaling pathway inhibitor 3
  ENST ID: ENST00000529338
  CDS Start-End: 126-521
tctgctgagctcagcctctcttggtggatgtggggcggggcgctcgagtaggacccgacgccaaggggagggggctgacctgtgcttggtccaccccaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaaggagtgcatcatcgacgaggactgtgggcccagcatgtactgccag

SEQ ID NO: 126745 - DNA, 1326 bp, Homo sapiens
  Payload ID: 4849
  Gene Symbol: DKK3
  Gene Name: dickkopf WNT signaling pathway inhibitor 3
  ENST ID: ENST00000525493
  CDS Start-End: 159-1253
gcgttatcctggctggagcacggtgtcaatcacggcagactaaggccagcggtgatggcttgaatgccaggctgggggctgggatttttcctgaggatttcacaggacagaggttggcttggaaagaccaaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacaggctcccacgtttagagcctggctttgtcccatctctccccagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgt

SEQ ID NO: 126746 - DNA, 903 bp, Homo sapiens
  Payload ID: 4849
  Gene Symbol: DKK3
  Gene Name: dickkopf WNT signaling pathway inhibitor 3
  ENST ID: ENST00000533813
  CDS Start-End: 200-903
agatccagtccggcccgcagcgcaactcggtccagtcggggtgggtgaggggcggcggcgggggaggggacgactctgctgagctcagcctctcttggtggatgtggggcggggcgctcgagtaggacccgacgccaaggggagggggctgacctgtgcttggtccaccccaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcc

SEQ ID NO: 126747 - DNA, 592 bp, Homo sapiens
  Payload ID: 4849
  Gene Symbol: DKK3
  Gene Name: dickkopf WNT signaling pathway inhibitor 3
  ENST ID: ENST00000534511
  CDS Start-End: 43-592
gttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaaggagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccaga

SEQ ID NO: 126748 - DNA, 894 bp, Homo sapiens
  Payload ID: 4850
  Gene Symbol: DKK4
  Gene Name: dickkopf WNT signaling pathway inhibitor 4
  Uniprot ID: Q9UBT3
  ENST ID: ENST00000220812
  CDS Start-End: 188-862
gtcagactttgctcagccgatttcacgcaccttactcagactaaggtttacttctttcagaaaaagcagtgacaaacagacgacgtgctgagctgccagcttagtggaagctctgctctgggtggagagcagcctcgctttggtgacgcacagtgctgggaccctccaggagccccgggattgaaggatggtggcggccgtcctgctggggctgagctggctctgctctcccctgggagctctggtcctggacttcaacaacatcaggagctctgctgacctgcatggggcccggaagggctcacagtgcctgtctgacacggactgcaataccagaaagttctgcctccagccccgcgatgagaagccgttctgtgctacatgtcgtgggttgcggaggaggtgccagcgagatgccatgtgctgccctgggacactctgtgtgaacgatgtttgtactacgatggaagatgcaaccccaatattagaaaggcagcttgatgagcaagatggcacacatgcagaaggaacaactgggcacccagtccaggaaaaccaacccaaaaggaagccaagtattaagaaatcacaaggcaggaagggacaagagggagaaagttgtctgagaacttttgactgtggccctggactttgctgtgctcgtcatttttggacgaaaatttgtaagccagtccttttggagggacaggtctgctccagaagagggcataaagacactgctcaagctccagaaatcttccagcgttgcgactgtggccctggactactgtgtcgaagccaattgaccagcaatcggcagcatgctcgattaagagtatgccaaaaaatagaaaagctataaatatttcaaaataaagaagaatccacattgca

SEQ ID NO: 126749 - DNA, 1222 bp, Homo sapiens
  Payload ID: 4851
  Gene Symbol: DKKL1
  Gene Name: dickkopf-like 1
  Uniprot ID: Q9UK85
  ENST ID: ENST00000221498
  CDS Start-End: 406-1134
agggccgcaatcagagaacaccgccaggacttccaggacttggtctccaggactgaggtcaactgacgtgggcgtggtctgactgtgtgggcgtggccagggaatgaactcacggctctggcttaaggggtgtggtgaacgaaggatggggcgtggctgtgtcaccaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacagtacgtgggcggccggaatccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaa

SEQ ID NO: 126750 - DNA, 524 bp, Homo sapiens
  Payload ID: 4851
  Gene Symbol: DKKL1
  Gene Name: dickkopf-like 1
  ENST ID: ENST00000594268
  CDS Start-End: 134-436
gccgaccatagcagacaaagaccccagccaagcccagtggcgctgcggcgttcaggacccccgtaggccaaaatcccagcccagcccttccccatgtggccagacaaagggacggtggagccgggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaa

SEQ ID NO: 126751 - DNA, 775 bp, Homo sapiens
  Payload ID: 4851
  Gene Symbol: DKKL1
  Gene Name: dickkopf-like 1
  ENST ID: ENST00000596402
  CDS Start-End: 401-775
gaacgaaggatggggcgtggctgtgtcaccaagggcgtggtcatggagtagaggcccgggctcctgggtgaggccggcaagtttggagcgtggtcagacaataggggcgtggctacggctcgcggagcgcaaccaacgctctagaccagacctgggctcgagaccataactgtttggctttaacacctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatc

SEQ ID NO: 126752 - DNA, 500 bp, Homo sapiens
  Payload ID: 4851
  Gene Symbol: DKKL1
  Gene Name: dickkopf-like 1
  ENST ID: ENST00000598682
  CDS Start-End: 1-412
cgctgcagctcctatccatgatgctgacgcccaagagagctccttgggtctcacaggcctccagagcctactccaaggcttcagccgacttttcctgaaagtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagacccacttactgtacatcctcaggccctctcggcagctgtaggggtggggaccggggagcacctgcctgtagcccccatcagaccctgccccaagcaccatatggaaataaagttctttcttacatctaa

SEQ ID NO: 126753 - DNA, 664 bp, Homo sapiens
  Payload ID: 4851
  Gene Symbol: DKKL1
  Gene Name: dickkopf-like 1
  ENST ID: ENST00000597546
  CDS Start-End: 66-664
ccgggagtccggtgacccgggctgtggtctagcataaaggcggagcccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctcccactccaggctgtccccccgaaagaccca

SEQ ID NO: 126754 - DNA, 767 bp, Homo sapiens
  Payload ID: 4851
  Gene Symbol: DKKL1
  Gene Name: dickkopf-like 1
  ENST ID: ENST00000597873
  CDS Start-End: 331-767
gcagattcctcatctacaggcgctagtggactggagacggctggcggctgtcccgggacggggaagagagctttggtgcctgagggaagatggcttagggcccggtcccttaaggcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagccacctccagatcgacaagatgaccgacaacaagacaggagaggtgctgatctccgagaatgtggtggcatccattcaaccagcggaggggagcttcgagggtgatttgaaggtacccaggatggaggagaaggaggccctggtacccatccagaaggccacggacagcttccacacagaactccatccccgggtggccttctggatcattaagctgccacggcggaggtcccaccaggatgccctggagggcggccactggctcagcgagaagcgacaccgcctgcaggccatccgggatggactccgcaaggggacccacaaggacgtcctagaagaggggaccgagagctcctc

SEQ ID NO: 126755 - DNA, 2880 bp, Homo sapiens
  Payload ID: 4852
  Gene Symbol: DMBX1
  Gene Name: diencephalon/mesencephalon homeobox 1
  Uniprot ID: Q8NFW5
  ENST ID: ENST00000360032
  CDS Start-End: 15-1148
aggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctgacatcatcttggaggcccgttatggttcccagcaccgcaaacaacgtcgcagccgcacagcgttcacggctcagcagctcgaggccctggaaaagaccttccagaagactcactacccagatgtggtgatgcgtgagaggctggccatgtgcaccaacctgcctgaggcccgggtgcaggtgtggttcaagaaccgccgggccaagttccggaagaagcagcgtagcctgcagaaggaacagctccagaagcagaaggaggctgagggctcccatggggaaggcaaggccgaggcccccactccagatacccagctggacactgagcagcccccacgtctgcctggcagcgacccccctgctgagcttcacctgagtctgtctgagcagtcagccagtgagtcagcccccgaggatcagccggaccgtgaggaggaccccagggcaggggctgaggaccccaaagctgagaagagccctggggctgacagcaaggggctgggctgcaagaggggcagccccaaggcagattccccaggcagcctgaccatcactcctgtggccccagggggtggcctcctgggcccctcccactcctattcctcgtccccgctgagcctcttccgtctgcaggagcaattccgccagcacatggcggccaccaacaacctggtgcactactcgtccttcgaagtagggggtccggcccctgctgctgcagcggcggctgctgctgtgccctacctgggcgtcaacatggccccgctgggctcactgcactgccagtcctactaccagtccctgtcagcagccgctgctgcccaccagggtgtgtgggggtctcctctgctgcctgcacccccagcaggcctggctcctgcatcagctaccctgaacagtaaaaccacaagcatcgagaacctgcggctccgggccaagcagcacgcggcctccctgggactcgatacgctgcccaactgactgtctggcttccaacccagccaggggtcttaggtgtcccctcctagccctgtggttatccctaggtggctctcgaggagttaactccatgagcccagggatcctagggcctggggtcctgttccctgctccgcttccccataccccagcccgaggtgaagcccacacctacacaccctctgcatggccctgcctggaccccatggaggccgaatagggaggaggtgagaggctggggtgccccaagcttccctcggagaagtgagaggctctccctggctagatcctcatctcaatagcacctcctcccttttctccctatccttctgccccctagtaagtctacgtgtggaatgtgagatataaatataaatatataaagctatattttcaggctcctgcctgccccaggccccctgccccactcccatctcttcttccctgccacccctccctgcagcctccgcggctcactccagccatcccttctgtttctccttctctctccttccttcttcccttgatctccctcttcctgtctctgtcctggtccctgcccccgtctcggcccagcctctgtattctccacccttgatctttctccttgtctctcccgctgcccctggtttcttcctttggtgttggctgtgttggtatcatcagttcttgagctatattttgtttggggttgtggctggttttggttttagtaattttgcgacttcccgttgctctccttctattcccttccttctgccctgcctgcctccctgcacctgcggcctctctaggaagctgttcctttctatgcccaatagaagcaacaaggccctagctggagactctggggatctggagctgcaggcaggaggtggcactggctcccactcccacccctgcccaggctggcatctagaaggcgtcatgaattactttctcttctctcttctcaattttgaggtcctcattcccaagattgaggaggcagtagttaatctgggaaggcagtagaatggccagcattcctgcctgtaagtcttcccaagacagaggcccggtgacacagttcagccaggactgaccacagggctctagagctctctttggtgagacttccctggatggagagcagcagcaggggaagaggtgctctcagagacagcagggctggtgctcttctcccacaagctgagcctccacgttcagcagatactgtccaaggcaggggtacggctgaccaggaatgaaggttgaactctgctcctgagcacggtgcgtgcaaagcatatagcagcacataggctcaggcttctgtaggcttcctgtcccagagccaattatggaagtaagggcttccctccagctagtcactggaatggaaaagtgtgttcctgttcatagccaggaaacccagctcagcaaactccctttcaaagctgtgtgaccggctgggcatggtggctcacacctgtaatcccagcactttgggaggccaaggcaggcaatcacctgaggtcaggagttcaagaccagcctggctaacatgtgaaactaataataatacaaaaattagctgggcgtggtggcacatgcctgtaatcccagctacttgggaggctgagttgggaggattgctgcaatctgggaggtggaagttgcagtgagccgagatcatgccactgcactccagcctgggcgacggagtgagactccatctcaaaaaaaaaaaaaa

SEQ ID NO: 126756 - DNA, 2882 bp, Homo sapiens
  Payload ID: 4852
  Gene Symbol: DMBX1
  Gene Name: diencephalon/mesencephalon homeobox 1
  Uniprot ID: Q8NFW5
  ENST ID: ENST00000371956
  CDS Start-End: 16-1164
taggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctggctgtacatttcaagacatcatcttggaggcccgttatggttcccagcaccgcaaacaacgtcgcagccgcacagcgttcacggctcagcagctcgaggccctggaaaagaccttccagaagactcactacccagatgtggtgatgcgtgagaggctggccatgtgcaccaacctgcctgaggcccgggtgcaggtgtggttcaagaaccgccgggccaagttccggaagaagcagcgtagcctgcagaaggaacagctccagaagcagaaggaggctgagggctcccatggggaaggcaaggccgaggcccccactccagatacccagctggacactgagcagcccccacgtctgcctggcagcgacccccctgctgagcttcacctgagtctgtctgagcagtcagccagtgagtcagcccccgaggatcagccggaccgtgaggaggaccccagggcaggggctgaggaccccaaagctgagaagagccctggggctgacagcaaggggctgggctgcaagaggggcagccccaaggcagattccccaggcagcctgaccatcactcctgtggccccagggggtggcctcctgggcccctcccactcctattcctcgtccccgctgagcctcttccgtctgcaggagcaattccgccagcacatggcggccaccaacaacctggtgcactactcgtccttcgaagtagggggtccggcccctgctgctgcagcggcggctgctgctgtgccctacctgggcgtcaacatggccccgctgggctcactgcactgccagtcctactaccagtccctgtcagcagccgctgctgcccaccagggtgtgtgggggtctcctctgctgcctgcacccccagcaggcctggctcctgcatcagctaccctgaacagtaaaaccacaagcatcgagaacctgcggctccgggccaagcagcacgcggcctccctgggactcgatacgctgcccaactgactgtctggcttccaacccagccaggggtcttaggtgtcccctcctagccctgtggttatccctaggtggctctcgaggagttaactccatgagcccagggatcctagggcctggggtcctgttccctgctccgcttccccataccccagcccgaggtgaagcccacacctacacaccctctgcatggccctgcctggaccccatggaggccgaatagggaggaggtgagaggctggggtgccccaagcttccctcggagaagtgagaggctctccctggctagatcctcatctcaatagcacctcctcccttttctccctatccttctgccccctagtaagtctacgtgtggaatgtgagatataaatataaatatataaagctatattttcaggctcctgcctgccccaggccccctgccccactcccatctcttcttccctgccacccctccctgcagcctccgcggctcactccagccatcccttctgtttctccttctctctccttccttcttcccttgatctccctcttcctgtctctgtcctggtccctgcccccgtctcggcccagcctctgtattctccacccttgatctttctccttgtctctcccgctgcccctggtttcttcctttggtgttggctgtgttggtatcatcagttcttgagctatattttgtttggggttgtggctggttttggttttagtaattttgcgacttcccgttgctctccttctattcccttccttctgccctgcctgcctccctgcacctgcggcctctctaggaagctgttcctttctatgcccaatagaagcaacaaggccctagctggagactctggggatctggagctgcaggcaggaggtggcactggctcccactcccacccctgcccaggctggcatctagaaggcgtcatgaattactttctcttctctcttctcaattttgaggtcctcattcccaagattgaggaggcagtagttaatctgggaaggcagtagaatggccagcattcctgcctgtaagtcttcccaagacagaggcccggtgacacagttcagccaggactgaccacagggctctagagctctctttggtgagacttccctggatggagagcagcagcaggggaagaggtgctctcagagacagcagggctggtgctcttctcccacaagctgagcctccacgttcagcagatactgtccaaggcaggggtacggctgaccaggaatgaaggttgaactctgctcctgagcacggtgcgtgcaaagcatatagcagcacataggctcaggcttctgtaggcttcctgtcccagagccaattatggaagtaagggcttccctccagctagtcactggaatggaaaagtgtgttcctgttcatagccaggaaacccagctcagcaaactccctttcaaagctgtgtgaccggctgggcatggtggctcacacctgtaatcccagcactttgggaggccaaggcaggcaatcacctgaggtcaggagttcaagaccagcctggctaacatgtgaaactaataataatacaaaaattagctgggcgtggtggcacatgcctgtaatcccagctacttgggaggctgagttgggaggattgctgcaatctgggaggtggaagttgcagtgagccgagatcatgccactgcactccagcctgggcgacggagtgagactccatctc

SEQ ID NO: 126757 - DNA, 3725 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000268676
  CDS Start-End: 90-1628
atccagcgcagccgggagacagatgcgaggcggcggtcagcaggtgccgaacccacggccaggcttccgtggccagcagccctagaggaatggccatcctgtccctgcgagcccctgggccctggcaggcgatgcaggtatgggcagacaggacgctgttgactccgcacaccggggtgacttctcaggttctcggggtggcagctgcagtgatgacaccgcttcctggtggtcacgccgcgggcaggacgcgggaggccaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 126758 - DNA, 852 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000418391
  CDS Start-End: 128-721
agatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattaca

SEQ ID NO: 126759 - DNA, 651 bp, Homo sapiens
  Payload ID: 4853
  Gene Symbol: DEF8
  Gene Name: differentially expressed in FDCP 8 homolog (mouse)
  ENST ID: ENST00000569061
  CDS Start-End: 249-651
agatgcgaggcggcggtcagcaggtgccgaacccacggccaggcttccgtggccagcagccctagaggaatggccatcctgtccctgcgagcccctgggccctggcaggcgatgcagaaggaggagtgatgttgggatggcctgatttctcctgtgtcctgggtgctccctgggagactggggaggtgctggcatcgggtggccgcctctgactctgtgacccacccacagtcatcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgag

SEQ ID NO: 126760 - DNA, 573 bp, Homo sapiens
  Payload ID: 4853
  Gene Symbol: DEF8
  Gene Name: differentially expressed in FDCP 8 homolog (mouse)
  ENST ID: ENST00000562578
  CDS Start-End: 43-573
gtagcggggcggccgggcggatccagcgcagccgggagacagatgcgaggcggcggtcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaac

SEQ ID NO: 126761 - DNA, 279 bp, Homo sapiens
  Payload ID: 4853
  Gene Symbol: DEF8
  Gene Name: differentially expressed in FDCP 8 homolog (mouse)
  ENST ID: ENST00000564836
  CDS Start-End: 82-279
gttggggaaagggggtggtccgtggtgagcctggtacctggggactcatcctggccctgcctggccctcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtct

SEQ ID NO: 126762 - DNA, 612 bp, Homo sapiens
  Payload ID: 4853
  Gene Symbol: DEF8
  Gene Name: differentially expressed in FDCP 8 homolog (mouse)
  ENST ID: ENST00000561784
  CDS Start-End: 168-491
gtagcggggcggccgggcggatccagcgcagccgggagacagatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtggatgggcctttgactgcccccgcccccaacctgggcagggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgct

SEQ ID NO: 126763 - DNA, 549 bp, Homo sapiens
  Payload ID: 4853
  Gene Symbol: DEF8
  Gene Name: differentially expressed in FDCP 8 homolog (mouse)
  ENST ID: ENST00000566820
  CDS Start-End: 168-549
gtagcggggcggccgggcggatccagcgcagccgggagacagatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctcc

SEQ ID NO: 126764 - DNA, 468 bp, Homo sapiens
  Payload ID: 4853
  Gene Symbol: DEF8
  Gene Name: differentially expressed in FDCP 8 homolog (mouse)
  ENST ID: ENST00000562986
  CDS Start-End: 93-468
agcgcagccgggagacagatgcgaggcggcggtcagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatct

SEQ ID NO: 126765 - DNA, 1554 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000567874
  CDS Start-End: 174-1349
agatgcgaggcggcggtcagcaggtgccgaacccacggccaggcttccgtggccagcagccctagaggaatggccatcctgtccctgcgagcccctgggccctggcaggcgatgcagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacct

SEQ ID NO: 126766 - DNA, 572 bp, Homo sapiens
  Payload ID: 4853
  Gene Symbol: DEF8
  Gene Name: differentially expressed in FDCP 8 homolog (mouse)
  ENST ID: ENST00000567884
  CDS Start-End: 253-572
agatgcgaggcggcggtcagcaggtgccgaacccacggccaggcttccgtggccagcagccctagaggaatggccatcctgtccctgcgagcccctgggccctggcaggcgatgcaggaagaaggaggagtgatgttgggatggcctgatttctcctgtgtcctgggtgctccctgggagactggggaggtgctggcatcgggtggccgcctctgactctgtgacccacccacagtcatcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaa

SEQ ID NO: 126767 - DNA, 1852 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000569453
  CDS Start-End: 394-1749
agacagatgcgaggcggcggtcagcaggtgccgaacccacggccaggcttccgtggccagcagccctagaggaatggccatcctgtccctgcgagcccctgggccctggcaggcgatgcagcccggaggagagctggtagcctagagtacagctgctgggcagaacggaggtgtccctgccagcgtgccttccttgacgctcctctggccatgttttaaacaccaggaggtttccagcggcttccccaggcgtagctcctgcacctttttcctgggctggtcaccatatgtgatgacagtgccagtctgttctgagcagctctgggctcctggcttcactgacatcataaacaagtccttagcccttccatccaccccagaaagtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctgg

SEQ ID NO: 126768 - DNA, 558 bp, Homo sapiens
  Payload ID: 4853
  Gene Symbol: DEF8
  Gene Name: differentially expressed in FDCP 8 homolog (mouse)
  ENST ID: ENST00000561959
  CDS Start-End: 31-558
agatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccgg

SEQ ID NO: 126769 - DNA, 3549 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000570182
  CDS Start-End: 128-1453
agatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttt

SEQ ID NO: 126770 - DNA, 516 bp, Homo sapiens
  Payload ID: 4853
  Gene Symbol: DEF8
  Gene Name: differentially expressed in FDCP 8 homolog (mouse)
  ENST ID: ENST00000566079
  CDS Start-End: 107-516
gtagcggggcggccgggcggatccagcgcagccgggagacagatgcgaggcggcggtcaggtgccgaacccacggccaggcttccgtggccagcagccctagaggaatggccatcctgtccctgcgagcccctgggccctggcaggcgatgcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacat

SEQ ID NO: 126771 - DNA, 578 bp, Homo sapiens
  Payload ID: 4853
  Gene Symbol: DEF8
  Gene Name: differentially expressed in FDCP 8 homolog (mouse)
  ENST ID: ENST00000567999
  CDS Start-End: 129-578
gcgtgccatgaacctccgcgccggaggcggcagcagcgagcgcggggctggatccagcgtagcggggcggccgggcggatccagcgcagccgggagacagatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaag

SEQ ID NO: 126772 - DNA, 580 bp, Homo sapiens
  Payload ID: 4853
  Gene Symbol: DEF8
  Gene Name: differentially expressed in FDCP 8 homolog (mouse)
  ENST ID: ENST00000561741
  CDS Start-End: 23-580
atccagcgcagccgggagacagatgcgaggcggcggtcaggttctcggggtggcagctgcagtgatgacaccgcttcctggtggtcacgccgcgggcaggacgcgggaggccaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacc

SEQ ID NO: 126773 - DNA, 1767 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000563795
  CDS Start-End: 120-1424
ggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccggg

SEQ ID NO: 126774 - DNA, 4450 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000563594
  CDS Start-End: 998-2353
agctgaatcttccacgcgagaagcctaagagtagggatacgggggcggggagcagcaggcctgctctgtgtgtaaacaacgggaaagcaggaataacgccagggcccgcggacaccagctgcctccgaagtcccgctgcccggcgcctgcatggagcagcctcctgagcgcagtgtggcgcgtcctcctgtgtaaagagggtagagccgcgccgggtccctccctctgcagccgtgaagcccccgcggggccctgcaggtggctggcggcacctgcacacggtggttctctgttcctttttcctcctcaaccactgaggttaaaaaaagtgttaaaagccaccctttttgtttttttgagacggagtctcgctctgtcgcccaggctggagtgcagtggtgcgatctcggctcactccgagctccgcctcccgggttcacgccgttctcccgcctcagcctcccgcgtagctgggactacaggcgcccgccaccgcgcccggctaatttttcgtatttttagtggagacggggtttcaccgtgttagccaggatggtctcgatctcctgacctcgcgatccgcccgcctcggcctcccgaagcgctgggatgacaggcgtgagccgccgcgcccgcccattttttttaaacgtgttggggtttgggtttcagccacaggccttctgcgatgagaggaaacccaggacgcgcagccccaggtcaggcccgcggaacagccgggcggactccggggctcgcagactcgcgacccgcgtgccatgaacctccgcgccggaggcggcagcagcgagcgcggggctggatccagcgtagcggggcggccgggcggatccagcgcagccgggagacagatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttta

SEQ ID NO: 126775 - DNA, 816 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000610455
  CDS Start-End: 95-688
agcgagcgcggggctggatccagcgtagcggggcggccgggcggatccagcgcagccgggagacagatgcgaggcggcggtcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaatt

SEQ ID NO: 126776 - DNA, 3883 bp, Homo sapiens
  Payload ID: 4853
  Gene Symbol: DEF8
  Gene Name: differentially expressed in FDCP 8 homolog (mouse)
  Uniprot ID: Q6ZN54
  ENST ID: ENST00000617948
  CDS Start-End: 432-1787
agcgagcgcggggctggatccagcgtagcggggcggccgggcggatccagcgcagccgggagacagatgcgaggcggcggtcagcaggtgccgaacccacggccaggcttccgtggccagcagccctagaggaatggccatcctgtccctgcgagcccctgggccctggcaggcgatgcagcccggaggagagctggtagcctagagtacagctgctgggcagaacggaggtgtccctgccagcgtgccttccttgacgctcctctggccatgttttaaacaccaggaggtttccagcggcttccccaggcgtagctcctgcacctttttcctgggctggtcaccatatgtgatgacagtgccagtctgttctgagcagctctgggctcctggcttcactgacatcataaacaagtccttagtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcggggtgtgcccagtgaggccaggcagtgcgactacaccggccagtactactgcagccactgccactggaacgacctggctgtgatccctgcacgcgttgtacacaactgggactttgagcctcgaaaggtttctcgctgcagcatgcgctacctggcgctgatggtgtctcggcccgtactcaggctccgggagatcaaccctctgctgttcagctacgtggaggagctggtggagattcgcaagctgcgccaggacatcctgctcatgaagccgtacttcatcacctgcagggaggccatggaggctcgtctgctgctgcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgagcggtgccaggccaagggcttcgtgtgtgagctctgcagagagggcgacgtgctgttcccgttcgacagccacacgtctgtgtgcgccgactgctccgcggtcttccacagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttt

SEQ ID NO: 126777 - DNA, 2658 bp, Homo sapiens
  Payload ID: 4854
  Gene Symbol: DPCR1
  Gene Name: diffuse panbronchiolitis critical region 1
  Uniprot ID: Q3MIW9
  ENST ID: ENST00000304311
  CDS Start-End: 1-1554
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 126778 - DNA, 2627 bp, Homo sapiens
  Payload ID: 4854
  Gene Symbol: DPCR1
  Gene Name: diffuse panbronchiolitis critical region 1
  ENST ID: ENST00000416153
  CDS Start-End: 1-1524
ccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcagccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacaagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 126779 - DNA, 2627 bp, Homo sapiens
  Payload ID: 4854
  Gene Symbol: DPCR1
  Gene Name: diffuse panbronchiolitis critical region 1
  ENST ID: ENST00000448092
  CDS Start-End: 1-1524
ccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccagactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaataggctcatctctgagttctcaggacccttgcccccacccccatttttttaatgaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcctatggccatttcaccttattactgattgggtagagggggaaaaggagaatgatgatgatagtttccttctgtctattgaccttttttataataaagtataacatgtttataaaggg

SEQ ID NO: 126780 - DNA, 2627 bp, Homo sapiens
  Payload ID: 4854
  Gene Symbol: DPCR1
  Gene Name: diffuse panbronchiolitis critical region 1
  ENST ID: ENST00000414703
  CDS Start-End: 1-1524
ccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacactggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 126781 - DNA, 5314 bp, Homo sapiens
  Payload ID: 4854
  Gene Symbol: DPCR1
  Gene Name: diffuse panbronchiolitis critical region 1
  ENST ID: ENST00000462446
  CDS Start-End: 29-4210
ggtccccaagcagccacccagctccgacatggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctatagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagagcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaaggg

SEQ ID NO: 126782 - DNA, 1689 bp, Homo sapiens
  Payload ID: 4854
  Gene Symbol: DPCR1
  Gene Name: diffuse panbronchiolitis critical region 1
  Uniprot ID: Q3MIW9
  ENST ID: ENST00000547331
  CDS Start-End: 1-1554
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacaccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttca

SEQ ID NO: 126783 - DNA, 2695 bp, Homo sapiens
  Payload ID: 4854
  Gene Symbol: DPCR1
  Gene Name: diffuse panbronchiolitis critical region 1
  ENST ID: ENST00000548730
  CDS Start-End: 29-2695
ggtccccaagcagccacccagctccgacatggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctacagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagggcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggcc

SEQ ID NO: 126784 - DNA, 1689 bp, Homo sapiens
  Payload ID: 4854
  Gene Symbol: DPCR1
  Gene Name: diffuse panbronchiolitis critical region 1
  Uniprot ID: Q3MIW9
  ENST ID: ENST00000546848
  CDS Start-End: 1-1554
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccagactcacaatttctatttccgggactacaggaagggcagagaatactgacggttaccagtattaacccttca

SEQ ID NO: 126785 - DNA, 1689 bp, Homo sapiens
  Payload ID: 4854
  Gene Symbol: DPCR1
  Gene Name: diffuse panbronchiolitis critical region 1
  ENST ID: ENST00000614587
  CDS Start-End: 1-1554
atggcccagccggtccacagcctctgctccgcctttggcctccagtgctgcctcctcttccttctagcttcttggggggcaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacaagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttca

SEQ ID NO: 126786 - DNA, 5392 bp, Homo sapiens
  Payload ID: 4855
  Gene Symbol: DGCR14
  Gene Name: DiGeorge syndrome critical region gene 14
  Uniprot ID: Q96DF8
  ENST ID: ENST00000252137
  CDS Start-End: 45-1475
cctgtgacgcgcctgctgggcccgagctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggagcggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacagtctggggggttgcctctccatcttgctccccacacgagccctagccttgccctggggcctgcatcacgtctcaggactgcggggcttgaagcgaggggccccccaggtgaggaagctgcaggtggggcggctgtgggagcaccgggtgactggcgttgctttctgcggcactcggaacctgtgttctgagttgagctcacatcctgcagtgctttctgcttctctggggggatatgaaggagaaacggagcccttggaagttgtacccttaggttcccctgcggttctgggcccaggtctgcagcctccactctgggcttgccggctgtgaggtgcgctggttataggactgtgtgggggctgcatatcaggtgatctcagctatcaccttctcccagcacctggcttccagctcatggggtgggactatcccactcacccctctgctataggcactgcccatcttatgctgctggccctggcctcacctggtcacttccaccaacaggagctcccagataacagtgggttgctggacagatcaggctgggactcttaaggggtgggggacgtggggccttcagtgctttatcccctaggaaagggtgcacgttatcccaagggagcccccaggaagtggggagggaggggggaggagcatgtctaggtgctgaccacctggagcacttggccagcaagtgggccgcatgctttgggagcaatgggtgacccagcaggaagcacaaaagaccggccagtgtgccatcatcaagggctgctgagcagcttgaagagccactgggtggggagggcacacggggaggtctcagctggggctgcccctggaggacagggcagggaacttgagggctgaggacagaaatctcacatgactccaggaaatagaggaagaggaggatgctgagcgagggattgtgagggagtgggggtaggtcagagggggctgaactgcaggaagccagggggagtcgtggaccactggagctggccagccccagggcattggggacaaggccaggtcagagggagacagtgtgggcctggtgggtggaccctggcagaggccctcttgtcccccacaaggccaggccacactgtgattctgcctgtacctgagcatctgtcctgtgctcctaggccggagaccactgtgtgtcaggtggggcggttggctgagtcccagagaaaaacactcctcactgggcactcttgatgcttgcacacaccctgtggtttatttggtggtcagtaaggaacgtctttgctgctaagtggaagaaagctaatggaacgtaatcaaaatagtggtttaattgacgaattttacttgcacctgtgccttcttcagatcctacctgcctacttagtttacgtgaaggccgactgcaccatgccccccaaccccgacccccaccacacacaacggggccattgtcatgctaggtgcttgctttccccacctcagctccggagatgtgatggtctttggccctggaggtctcggccagcctgtcctccatcctgttctcgttctcgggcaccaccagcagccggtgctgggttttggctccaagcttgtggtcgggccggtggtcgggcctcaagcctgtcttggtgtccagtttgcactcagcgcggtacttgccctccccctccctcttgaaggaggcagaagacgtggctttgggcttggggggctgcagccacgagtggctgaggatctcatcgatgtggagccgctggctgacgtcgggctgcagcatgcggtagatgaggtccttgcactcgcaggtcaggttcttggagcgcgggaagtccacacggtgctccttctggatacgcagcatcttcctgatgtcggagtcgtcatagggcatggagccgcagaccatgatgtacaggatcacgcccaggctccagatgtcatacaccttgggctggtaggggatgctctgcagcacctcgggggctgcatatgctgccgacccgcagaaggtcttgctgaggatgatgcgcccattgctgtcccgcaggcagcgcttggagaagccaaagtcagacagcttgatgttgaagtccttgtcgaggagaaggttctcgcacttgaggtcccggtggacgatgtccaggtcgtggcagtacttgacggcggaggagagctgtcggaacatcttgcgtgccacgtcctcatgcagggctccctggcacttgatgaactcgaggaggtcgccctggacgccaagctccatgatgatgtagatccgtccgtcagaggtctcaaagatctcgtaagtcttgatgatggagccgtggttgacagttgccaggatgtccatctcccgaggaaggaatctctccacaaagtcagtaggtgttttcttgcggtcgatgatcttgacagccacattgaacttgaggcgctcagagtaggcagatttgacttttgcgtaggaacccttgccaagattgatgcctacgatgtaacccttcttccttaggactgtggcatcgtccatggtgccaggagcgactggcgccgctgccgtctacatccccccgtcatgtgggccagcaggcattgtcctcatttacactaccggaggcgtctggctgggctgccctgggctgggcttcgactcaggggtggaacactcagcattgtctccgggtgacttcagccaatgaactcataaagccaaggagtgggggcggggactgggctgagggagaacagggtctctggaaccgtggaagccaggctggtctggcaggagcacccactccccgcccgctggaaggaagcctgtccccaggacaggactctggtggccctgctgctgctgcattggtttccctgtcacaagtcaagctggaggggaggcggcccacgtccagcctgtttgcatcacctggctgtggggactgaccctgcattggtctttgtcccactagggtgggtttcctgcagcttctttggctatgaagaaaagcacccccagggctgtgtccttggtgtggtaggacagttgtccctgacagtcacccagacaggcctgcatagcaccccagttacacagacagatttccacagcactgccttaccattgagcacatagttaaatctagggaaatcagtgcccagacatcaaagctagaaatgaaacatggtcagcaggagccttgcatgggcttctcttttgctggagcaagccaaaataataggaacggttttacattcctagtgccaggacccatctcgggtcgacaaaatctgaagacaagttaagggaacaggcagctgtttgaatagatcaattggatagtctaaggcagctctctggaccaagctgtaaaggagatacaatcgaaataatcactccggtaccacagtagacaggccttgaaggcactgggccccttttaatcggacttagcaagcattttttttgcctctgaccttctccttggaacaaaattagttaccagtagacttaggtgattgctgtactgcatgtaggcacataaccccaacctatataaacagtaagaaaattgtagcactttgagttggtctgctggaattatctccagccttctccctgtatccagttacagtgataaactcccttctttccta

SEQ ID NO: 126787 - DNA, 1808 bp, Homo sapiens
  Payload ID: 4855
  Gene Symbol: DGCR14
  Gene Name: DiGeorge syndrome critical region gene 14
  ENST ID: ENST00000434568
  CDS Start-End: 45-926
cctgtgacgcgcctgctgggcccgagctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccaggggccctccctctctttctccaagaaggctgccaaccccagagccccagccttgccctgaggagaggaagtgtttccagcatgttcccacgtgtttgcccaccggccagctgtcgagcgtgggctgcggtccccctgatgccagcctctctgcttgttccagcacaaacagggcaaggtgtgaacgagtccccgatgatgacctggggggaggttgagaacacacccttgagagttgaagggtcggaaacgccctacgtggacaggacacccggcccagcttttaagatcctggagccaggccgcagggagcggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacag

SEQ ID NO: 126788 - DNA, 4480 bp, Homo sapiens
  Payload ID: 4856
  Gene Symbol: DGCR2
  Gene Name: DiGeorge syndrome critical region gene 2
  Uniprot ID: P98153
  ENST ID: ENST00000263196
  CDS Start-End: 249-1901
ggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 126789 - DNA, 4814 bp, Homo sapiens
  Payload ID: 4856
  Gene Symbol: DGCR2
  Gene Name: DiGeorge syndrome critical region gene 2
  ENST ID: ENST00000389262
  CDS Start-End: 1255-2235
gcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcaggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaagattggggtgtgagtgataccatggtacatagacgcttactatgcccatgtgtcggtaccctgcacacacatttgaagttgggagctcgtttccgcagggttcctgtgcgccttggtggagcgctctccaggcgctcccccaggcccacaccagcctgtgagccccgcctgggggccaagaccctgcaggtttgacagcaccaggtcatgatgtgccctggagacagaactgccgctgctgctgccagaagacatgaggccaggatttctgtaacatttgtgcagaaaggttgaaaaagtacagatccttgtgtagggagaatcatccacaccgccccacgtgctgctcccagggccttcccgtcagcaccagcagtgtagcttctgtctggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaa

SEQ ID NO: 126790 - DNA, 4361 bp, Homo sapiens
  Payload ID: 4856
  Gene Symbol: DGCR2
  Gene Name: DiGeorge syndrome critical region gene 2
  Uniprot ID: P98153
  ENST ID: ENST00000537045
  CDS Start-End: 249-1778
ggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaagagg

SEQ ID NO: 126791 - DNA, 4484 bp, Homo sapiens
  Payload ID: 4856
  Gene Symbol: DGCR2
  Gene Name: DiGeorge syndrome critical region gene 2
  ENST ID: ENST00000545799
  CDS Start-End: 249-1901
ggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtaacctcaggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaagagg

SEQ ID NO: 126792 - DNA, 1235 bp, Homo sapiens
  Payload ID: 4856
  Gene Symbol: DGCR2
  Gene Name: DiGeorge syndrome critical region gene 2
  ENST ID: ENST00000615747
  CDS Start-End: 249-1235
ggggcggggcggcgcggcgcggagccgagcaggacggccgccatcttgcgcgcagctggagtcggtgcctgaggttgcagccgagagtgtgcgccagcccgcggcccagccgaagctctttcccgccgcctctccgcgcctcgcccaggttcagctccgcctgaccctccgcttggcacggtcccctgaccctcagtccggcctggtccggccttccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtaacctcaggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacaccctctctcctgcacggccagagcgacttag

SEQ ID NO: 126793 - DNA, 1214 bp, Homo sapiens
  Payload ID: 4857
  Gene Symbol: DGCR6
  Gene Name: DiGeorge syndrome critical region gene 6
  Uniprot ID: Q14129
  ENST ID: ENST00000331444
  CDS Start-End: 153-815
cgcgaggcgcgccgcgatcggggactgtcctaagacgggcggggcgcgctgcgctagggactgtcataaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgca

SEQ ID NO: 126794 - DNA, 1199 bp, Homo sapiens
  Payload ID: 4857
  Gene Symbol: DGCR6
  Gene Name: DiGeorge syndrome critical region gene 6
  Uniprot ID: Q14129
  ENST ID: ENST00000427407
  CDS Start-End: 25-513
cggcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgccccgcaccttctggaatcccctggagacttgccgtgacagtggggtgggaggatggaggaggctggcgtcctccccagtgcagacacccctttggcctggctgctctgctgggttgtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtgg

SEQ ID NO: 126795 - DNA, 1039 bp, Homo sapiens
  Payload ID: 4857
  Gene Symbol: DGCR6
  Gene Name: DiGeorge syndrome critical region gene 6
  ENST ID: ENST00000413981
  CDS Start-End: 386-640
ctcagcaagggccggtgggattctacatggtcctgcgatatccaggcgacggagtctcgcctctaaagtggcccggggagcaggaagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgca

SEQ ID NO: 126796 - DNA, 1435 bp, Homo sapiens
  Payload ID: 4857
  Gene Symbol: DGCR6
  Gene Name: DiGeorge syndrome critical region gene 6
  ENST ID: ENST00000480608
  CDS Start-End: 21-455
ggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccacccccttccaggcctgatggccctaggcctccgtgcttggttggccggcaggctgactctggtggtagatctgactgcgttgccctccggtaattggagttctgttgacaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgc

SEQ ID NO: 126797 - DNA, 3245 bp, Homo sapiens
  Payload ID: 4857
  Gene Symbol: DGCR6
  Gene Name: DiGeorge syndrome critical region gene 6
  ENST ID: ENST00000483718
  CDS Start-End: 51-365
gagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctgctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgagtgctcaggcaggcgctgcggcagaagcaccaggaagcccagcaggcctgccggccccataacctgcctgtgcttcaggcggctcagcagcgagaactagaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgcatgtggcttgtgtgatagctgcaggttctgccataaccggggccctggtagggcccccacctctgttgcagcagaggcctctacctgggggccccttcctgggctgtgtgcccagcccaccacccctccccctgcctggagactgggaccctccagcctttcctgccccagccctggtcccaggatgctgtcactgccatctgtacaggggcccccatccaagccccagggcatgaggaccacatccagcctgctttgtggggctgggggctggagagcatgggagaaggcccgaagtgcaagtatgcgcctgccgcagcctggtcagtgtcctgtgggaaccactaggaggagcctgatgcaggtcactggggtagaggactcagggtggcaggaatggcctgaggaggagccctgcggggaggcgtgccaggcccacctggggagcttggcctctgcatctgcatgagtcccctccgtgctggcctgggcccatgggccctgctgggtccttgtggagtcagggttgggggtgtccagcaccctgggtggccaggtctgcgcagggcctggcccccaggaacagatgatgctggaagccagagtctgggatgagacttctctgaccctgtctgagccactccctctttgttgcccagagctgaccctgtgtgagggcaaagggctctcagctgcaggaacagtggtttattgaccaggcaggcctccccagcccggccactgctccccaaggggctcgggctgtgtgggctggccttggcagaaggtggacaatcctctaggtccaaggacatgggggtcacagaggtgggggccttgggcccacacattcgaggagagttcccaaaagtttccagtggctgtcccaggcaggtatcaggttcggcccacacctgagtgcccatactctgggcagggctgggaggcacctgacctcacctccagcagctctgcaagtgtggggtgaaaaaaggtgaatctgtgtgaggatggggttggctgcagctgtggtgatggcctgggcgggggcggggggtgctggaggctaagggtgtgctggcgggtgctaggcagggcgatggaagaggttgccagttcggagccgcctcaagagctccagccacagcagctgccgctcccgatgggtgcccttcatgaggctgctgttctccagggcacggcgggacaagtagggcagcacctccatcacggggccatagggcacgtacttgtacacggggtagccggcctggcctgcatgggggcagatacaccatgaggcccaggcccagcaccgtaccccatcgcaccagggagggccccactcacccagcgggaagctgatctggtcacacatgcctagcagctgtccaaagtacacccggtggtcagcaggatgcaggcccagctcctccatcctgtgcaggtgaagccaggaactgagggccagttccaggacactgtccccagtgcagggatacagggctcctgtcccagctctgagcctgtcctgccatcccaggtgccccatctgcactctccagacttcatcccctgcaaggtggggctggggtatgggctctgcctggccctgccccagtgaggcctcttcccagcaggactctgctgggctgccctactcgtctccctggggaggcctcagcccttggccaacaaggcctcccacctgctttccctcccctctcctctctcacctctcctctagctcccttcttggaggtgcagcccttcctcgggccctgacccacccagcagcctgccccacagggcagagaagctcctcagctctcctgccatcccttcctcaagcccctccagggttctgtggtatgactggtctccggcccctgccctcgccctctgtgggctgctgccctgccccatccccacagctgctgtgtcccacacagctgccaccagcccccgagtcctcggaaggcggctgctctgaatcgagatgtgttgcaaatgtcaaatacacacgggatttaggagactttgtagaaaaataatgcacgatgccgcgttgcttttctaaaagcaactggaatacaatttgaagtaatattttgaatattttgggttaattaaaattattcttgaaattca

SEQ ID NO: 126798 - DNA, 1837 bp, Homo sapiens
  Payload ID: 4857
  Gene Symbol: DGCR6
  Gene Name: DiGeorge syndrome critical region gene 6
  ENST ID: ENST00000608842
  CDS Start-End: 23-457
gcggctagcgggcgtccgcgccatggagcgctacgcgggcgccttggaggaggtggcggacggtgcccggcagcaggagcgacactaccagctgctgtcggcgttacagagcctggtgaaggagttgcccagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccacccccttccaggcctgatggccctaggcctccgtgcttggttggccggcaggctgactctggtggtagatctgactgcgttgccctccggtaattggagttctgttgacaggtgagcagcgcccttgggtagttggaggtctgttgacagctgtgcgcgcccttcagggtcagttccctctcaggcctgcagggcctcattctagttgcacatcaaattcctaagcactgtctcctgtggcgccctcccaaaccagaagagcttcccacttgagccgcatgcttcctgggcttcggagccctttcctgcaaattatatagggcaggtccccctgcaccatcagatttccacctttgctgttttatttttcccaaacttcttattttaaaagttcaaacatttggaaaaactgaaaagacagtgtagtgcatacgcttgtgctctccaccgaaagttcagtagttaacattttgctctagttcttgacatcccaaaatacatacatgtgacagcatagaattcaccaagagtcttcagcattcctggagaccaggattttcaacccagccatgctgacatttgtggctgggtaagtctttatggtgagatgctgtcttgcgcattgcaggatggcaggggtaccctccctagtcgtgaaaaccaagaatgcctccagacaacctgggtggtggggtcaaccttggccttggattgggagcaagtgctctagaacaagagcggtctcctacacagctgcagagggtagccccctgagaaattaactgttccaggtgtctcctgactttcagtgcatggccacatcatggtacctaacttgtggcaaattgttgctttataagtaaggatccagtccaagttcatgtactacaattggttactttggtctctttgcttctggaacagtccccaacatttattgtggcattgactttttatagagtctaattctataattagaatgccctgctctggatctatcagaggaaatgcttcctcgtgcatttaacctgcttctccactctctgggtttactgtacactggactcctggtaggagcctgattagaggcaggtttaatgtggcaaaaattcctcctagcggggcaaggcccccttccccagaaggcaggcagtgtccatctgctccaggattggtgtgtttctatcaagaatggatgttggattttggcagtttcctttttggcagctcttgagatgatcacgtggtgaatcattttctattactacagtgaattacagtcacttgaattcca

SEQ ID NO: 126799 - DNA, 1154 bp, Homo sapiens
  Payload ID: 4858
  Gene Symbol: DGCR6L
  Gene Name: DiGeorge syndrome critical region gene 6-like
  Uniprot ID: Q9BY27
  ENST ID: ENST00000248879
  CDS Start-End: 93-755
aatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccacccgagcgcttgttctggtctcagccgctcccttggcagctgcagcccccatgcagaagaggctcccaggcccaagctctgtgtgacccagagaaataaagatgcctcagtgtggcccaaa

SEQ ID NO: 126800 - DNA, 962 bp, Homo sapiens
  Payload ID: 4858
  Gene Symbol: DGCR6L
  Gene Name: DiGeorge syndrome critical region gene 6-like
  ENST ID: ENST00000405465
  CDS Start-End: 22-570
cggctagcgggcgtccgcgccatggagcgctacgcggccgccttggaggaggtggcggacggtgcccggcagcaggagcgacactaccagttgctgtcggcgctacagagcctggtgaaggagttgcccagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccacccgagcgcttgttctggtctcagccgctcccttggcagctgcagcccccatgcagaagaggctcccaggcccaagctctgtgtgacccagagaaataaagatgcctcagtgtg

SEQ ID NO: 126801 - DNA, 935 bp, Homo sapiens
  Payload ID: 4858
  Gene Symbol: DGCR6L
  Gene Name: DiGeorge syndrome critical region gene 6-like
  ENST ID: ENST00000443409
  CDS Start-End: 93-386
aatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccaccc

SEQ ID NO: 126802 - DNA, 2895 bp, Homo sapiens
  Payload ID: 4859
  Gene Symbol: DIEXF
  Gene Name: digestive organ expansion factor homolog (zebrafish)
  ENST ID: ENST00000457820
  CDS Start-End: 1-746
actgctctacatggagctttttagctccacttcctcagcagtttcacctcaagatcctgttccttcctcttaccccactaaggctgctgttgctgtctgcacaggtactgatagtggtgccattccgggaagctgctttgcgggtggtgcagctcttcatcagcctcctcgagggtgacagcaagaagaaaatcattgtgagcaacaaaaagaggtttcagggagaatatggatcagatcccgaggagagaccacccaacttgaagaggcctgaggattatgaagccgtatttgtgggcaatattgatgaccacttcaggattggagtggcaatacttcagagaagcatccgactctatgccccgttttactcctcggatatcctcattgcttcccccctgggcttgaggaccatcattggtggagaaggagagaagaagagagattttgactttctgtcttctatcgagcttctcatcattgatcaagctgacatttacctgatgcagaactgggagcatgtcctgcatttgatgaatcacatgaacctactacccctggactcacatggggtagacttttctcgagtgcggatgtggagcctcaataattggtccaagtactatcgccagacactgctatttggggcccttcaggatgcccagatcaactcagtgttcaacaagtactgtgtcaacatgcaaggccaggtgggttctcgtcttgtttcctcagtatcttcatgagcactgtttattgtttgggtcctgaggtagaaggaggcgatagcttctggtcaagaaggggatggctgtccacctaacgctcttgttgactactggcaggtggccgtgaggaatgtcccaatgacaggctctatcagtcatgtcctggtgcagctcccacatgtcttccagaggatggaagctgaaaacctagcttcagtgattgatgccaggtaacccactcctcccagcaggcccctggggaccacatagagagatttgacttgggcatacaaacctagaattggattccattttgcttttattgataactaccaaatcagttgagataattgaacttaattatgtcatttgtcagaggaggaaactgaagcacagagagaaatagtgactttggcctaggtctcataactagttagtagcagggttattactataaatcaggactctttcactcttgactgtggcattttaaaattatacagctttatgctacaaagtgtctcatgtcagcaagttaattgtaagcccctcagggaaagaactatttttctaattgtataatttccccctttttcttcattgtgtttagttaggggaccccaaagaagcttagtgaggcttagtatatggtagatgttcagtgattatttgttgactgttggactgagtgactgagtgactgactgactgactgaatagtgtggtgtgtacttcctagagtaattctctgggatataatggtattacatctgttttttacaatgaatagtgttgacacttatttttttagtgtgcttatcaagttttatccttacataatctctttgagaggaggtaaatcatattggcctctggggaggtaatcttttaacacgagattgtaatttgctcagggtcacacagttaagagacaccataagcttagctctagacattaattttgccctttgccattccaaatcaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtaaagtggtgccaggtttcaagcctcctctctgaaggggaggtgcaggacaaatcatggcctgctctgaatgcatggcaggcttcgtggtgttgagatcatccctcactctcgcactcttacaaagtagccagagagtttttggtttggacagactcttcttggttggttagttggttttctcccaaaatgggcattgctgaagaaggatgtagaaaccaaagcataccctgtctatagacctggcatgtagctgtggttatacactgcaagaaggacattacaggacaactcaaatgaatacaaggaaggggagggaccttccctgtattcacttgagttgtccctgtctagactttttccctctgtttgccctcagtgcacagacaaaagcattgagaactgtgttttctggggagatggaggctgagtacagtgtcagtttccagacagttgcggtgttcctgaggtatgcacagatactccctaccaaggagaactaggaccgtgggctccttgacatttgcaggaggtaaaagggtaagggcttcaagttgaatgttgaagggtttcagcgtttgcttagatttcctaccaggtgactttgacaaaataagttgattggtcttcatgttatttttttaaaaactcaggccaggtgcagtggctcacacctgtaatcccagcactttgggaggccaaggcaggcgaatcacctgtggtcaggagttcaagaccatcccggctaacatggtgaaaccccgtttctactaaaaatataaaaaattagttgagcgtggtggtgtgtgcctataatcccagctactcgggaggctgaggcaggagaatagcttgaacccgggaggcagaggttgcagttagctgagatcgtgccattgcactccagcttgggcaacaagagcgaaactccatctc

SEQ ID NO: 126803 - DNA, 8446 bp, Homo sapiens
  Payload ID: 4859
  Gene Symbol: DIEXF
  Gene Name: digestive organ expansion factor homolog (zebrafish)
  Uniprot ID: Q68CQ4
  ENST ID: ENST00000491415
  CDS Start-End: 58-2328
caacttcctggtggaaaaccgcgactcttgcaagtgggcaaacttgacgttttcgctatgggcaaacgcgggagccggagccagagccagctactcaacaccctaactaaaaagcagaagaaacatcttcgagatttcggcgaggagcatcccttctatgacagggtttccagaaaggaagcaaagccacagatttgtcaactgtcagagagttcagattcttcagattctgaaagcgactcagagagtgaaccacaacaagtttctggctaccacagactacttgctacattaaagaatgtttctgaggaagaagaggaagatgaggaggaggaagaggaagaagacagtattgtagatgatgcagaaatgaacgatgaagatggtggtagcgatgtcagtgtggaagaagagatggctgcagagtctactgaaagtccagagaatgtagctttatctgctgaccctgagggaaaagaagatggggaagagccaccgggcacatcacaaacatcccccgaagagttcacagatgcaaaacacgagtcactgttcagcctggaaaccaattttctggaagaggaaagtggagacaactcttctttgaaagcctctcaagatccatttcttcaacatgtgaacaaagaactgaaagaaaaagcaattcaggctgttgccacaaatcccaaaactacccacgagcttaaatggcctattctgggccagcttttcttttcctctaagtttcagaagttggaaacatttaaacccccaaaggatattgacttaaagtcacttcatctccagaagcctctggaatccacctggactaagaccaacagccagttcctatctggtccccaaaaatcaagcagcccattcacccccctccagaaagaactcttcttaattatgaattcttaccgggacctgttctacccggaaaggactgctctgaagaacggggaagagatccgccatgtgtattgcctgcatgtgataaatcacatcctcaaagccaatgcccaggtgcttggcaacaatagcagacgccgaagccagaagtttggagtgggtgatgatgatgacttcagagaccaagggttaacaaggcccaaggtactgatagtggtgccattccgggaagctgctttgcgggtggtgcagctcttcatcagcctcctcgagggtgacagcaagaagaaaatcattgtgagcaacaaaaagaggtttcagggagaatatggatcagatcccgaggagagaccacccaacttgaagaggcctgaggattatgaagccgtatttgtgggcaatattgatgaccacttcaggattggagtggcaatacttcagagaagcatccgactctatgccccgttttactcctcggatatcctcattgcttcccccctgggcttgaggaccatcattggtggagaaggagagaagaagagagattttgactttctgtcttctatcgagcttctcatcattgatcaagctgacatttacctgatgcagaactgggagcatgtcctgcatttgatgaatcacatgaacctactacccctggactcacatggggtagacttttctcgagtgcggatgtggagcctcaataattggtccaagtactatcgccagacactgctatttggggcccttcaggatgcccagatcaactcagtgttcaacaagtactgtgtcaacatgcaaggccaggtggccgtgaggaatgtcccaatgacaggctctatcagtcatgtcctggtgcagctcccacatgtcttccagaggatggaagctgaaaacctagcttcagtgattgatgccaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcggcacagatgctacagtccaacaagaatgtccacctcttcattactggagaaaaatgaaattttgttgggcaggaagtggtatttggcatgatacataatgtttgattctatgccatttggacccaattctgattacttacagaagaaggactgatacaaagaaagtgcatgaggcaatgtcagtattatctgacatctttcttttcaggtcatgtgtccctgaaaagttaaatgtaaaccagattttggtaaatcccatctttcagaagtgaagagggggctagaaggactctgagaagttggtagaagaaaactcccacttgtgaatatttttgtgagacataaattcttttattacgatttacctctaatttattacacttagtaaattcttccagatttttctatttgtttgacacttccttaaagtaaggaatacacattgcttgcgagaactggttatgagacattggaatacttcttgctgctacatgtcatcttaattttggatggcatgggttttgtaaaacttattctgccccagccaaacttttttgaaaccttaaatagtctaccttaattcagcctagaagagtacattgatttactgatcttttttcatattcataatactaaatgttttagttttgttcaaatatatgcttaaaatcacgttatttaaaaaacacatcagctctgtctcaagaagtaattttgttgaaactccatgttaaaatatccatcttcaacagtagtgtcttcataataactagtcattttttcagtcataaacagatgcaaataaaaaggaaattacacttttaaaaacatttttattttgaaacattctcaaacagaaaaattccaagtacagaacctgaaccatttgagagtgagttgccaacccagtgggcctatcacctttaaatactttagtatatatttcctgtaaacaattaagggtattgtttgtgattaggaatgccccaccaataaggataatgtgaatatttcagaatccaaaaaaattcgaaacacgtctggtcccaagcatttcagataagagatattcaactcatcctagtatggactcgtagtttcttcttttattcaatgggttacggtttgttacatcattatttctttagatgcgtaactggtctcaaatatggccgctgggagcaccttcaggttagcccctgtgtacttttgacatgtcccccatctacttgggcactgctgtattttttgacaatgagacattccaggtttctctactccagccctgcttgcttttagtaggaaattattataaaaggttagattggagtgcttactattgtggtgccactcatcccaggctcagtggtcagaacttgggaattgtgtacatgtatgcacacacatatgtacacacgttgtctaaatttgcttcacattaatatctaaatttactttcatatccatatattgaaaaccatgaattcacaccagtacctccaattctagtccaacaacacaggattgcttctcattttctttccatattgataactcctttctcagacagtggctcccattatcctcaatgtaataacccatgattggtacagattttttttatccttgggcacgcttaaaattacttagcaaaaacaaaaagtaaaatcagttttgaagtaatatttctgctaaatatttagacatttttacttctttttcttcagcatggtaagtaaaaccatttattccatatttagatggttttctaaatttcagaaaatttagttagataaaagccgaccgaacccatgctacaaagaactttttgtatctataggcatgccctgtggttactggcgtaattgtgctgctgtttatcatagatcctgtatattatgagaataagaaatgagtttatttacctcattcagaaatgtgaggcgaagggactgtaattacctggatctttttttttttttttgagatggagtctcgctctgttgcccaggctggagtacactggcatgatcttggcttactgcaatctgtgcctcccgagttcaagcgattctcgtgcctccgcctcccaagtagctgggactacaggcgcatgccaccatgcacagctaattttttatatttttagtagagatggggttttgccatgttggccaggctggtctcaaactcttgacctcaagtgatctgcccacctcagcctcccaaagtgctggggttacaggcctgagccgccacgcctggccaattacctacatctttttctactgccatattcttttgcctgtgaattgtagttcatctcgtggtttccattattactattcacacgactcccaaatctccagcttctctggctctccactcacatgtgagtctggatttcaaatccatgatgtagccccagaaataaccattttattaagcacccctagtgattttcatgctggcatagagccaaacccagccaactgcttcttgcctgcagagaacactgaggatttcaagtgtgaacaaagtagtgttgctttgttcctggctcagcacctgaaaagaaggtaagcctctgcagttagccctggctccttagtgcattgcagagtggagtctctgcaatggttttattaaaaggatgccttgaagatctggtctctctcaacacacaataagcgagaagagaggctactgaaatacggatgcgtgagctggaattacacactaccttgatgttaacaaggctcatttgcagcaagcaagtgcctatatagggtctgaaatatagacaaaggatggtcccaatcctggaaacagtggaattaaaaggtatggaaaggaacttacccagaaagtaacacttttaaatgttttttcttttcccatagttaaaacaaccagcttagcacttttctttttgagagagaaaaagctttgaatcgtggatgcttctcacagctggctgcaccacgtgcagtgttcaaaaaacaagaacaagctaatcatagagaaccagcagcagctaaacagccctctgcttgcttccaaagggcttataattgagcacagatggtcctagtggagatggggaatgtgtccctgctgactcctcataccccagaggaccaaggggggctcatgaaggctctcagccctgattgtgccctcgtgagggcaaggagctatgctgctgaaggaggaaagggaaaggcaggtggggccagaccctattggccatctgaccagccttcccaagcccacgtgagcagatctagggtctcaagattacagaaggcctggggtgagggagcaagagttggaagttctttatagttgtctgaagagcctcattgtccaactgcaggggcctgaggtgcccaaagcttcgtggaaaagtaatgtcagtggaatgctcagaagtggctcttttcagggcacggcttctgaggagcgtggggccaccacagctagccctccctccgtctagccatcctctccttccagtccctttcccatcttttctctcaaaggagcatggtagtgatcttcattaccaaatttctactccacacttattttaaaaagcttttctgaaagcctggctacatagaattctaaacagatttcagtcaacttttaattagagtcaatgaatggggagtaaatacacagataatccaaaattgatgtaagcattggaaggggaaagagggaacgcttctttccctctgggcttggtcatttcctcccaagcaaaccccgcgacgttcagccgtcttcctcctatgccacgtgctctcaccagaactgcagcaaaactgcattttatgtcctgtgtctaaagctaaacacatgttcctgtctacttttgctttgttcctgtttcccttctgtgaggaccttcccctcctcagatgtggggagttgccgcctccacttgcattacatgtatttcagagtaggtcctaggctccccttacacctctggtcacgttgccattattcctatggtagataaaggggatgagaaagaacagagctccaggcctttttcaaacaaactggttttctcagtatagccctatgctcaaaaggagtgaggacaggtatgtgactgccataaggagctgtttgctttgcacagagaaatctaatctttctcctgctgggcagctcagtacagatgtcccctcactgctggaagaaacacctgcccttgcttgttctcctgatggcccctcacagtcaggtgtgggatggcacatttctaggtgctcctcgccgagctgtcatgggcttcagtcttgggcctctgcagctggctgtgaccaggtggaaactgtagccttggctgacccagagaaggaaaggaggcagtctgccgcttggctgatttaggagttgtgctgaattcctgcccatctgttctcccagctgagccaaggccaaagctgtctaccttttgccaacctaaggaatgacacagagcatggagcaccatcactgaaacatctgccccagtgccctgccaccttcgtcctcactgacctctgcagcctctctcatctgccagttttgattccgcaaggagaggtggccctgggctcacagctggtgtttgtccacagatgttcatgggtttctttgtgttctctcattttttcaaagctgggtgttgggaccaacatcaccactgacattctgtggctctaaacaagtcctcacgaccacttctcagttttctcatctttatgaagtatggagtaatccccactagccttatagagggactgtgtgagaagggaagagactgctattgtttgccctatatccacctacttccctagttccagaacgctggactttaatgagataacaaagtacctagtaaaaacactgcatcattttccatcccccaccccttgcagtaaaatgtggcccatgagacagaagcactaactactgagcaggacttctaggggagttctttaaaactcagaggagcaccacttttaccttctgctcttccctttttcctgcctggaacgcagaagtgatggctgaagctcctgaggctataagctctgtacgtaggagagtggtgaagaaaggagcttggttctgcaaggatgttgtagagctgccataccagtcctgcatggtattcctgtgcactactgttacgtgaacacacaaacacctaatttgtttaagccattaggccaggcctctattagccattcctgactgatacagaagacaaaaatggcatcacagactcctgaactccaaagacactgcctattctttcgtctgttcttggcaagcaccaacattgagactgtacttcagggttgatgctggccatttggtggcgtgaggagtgggcactcacatgtctctgctagcagttctgacgtgtccattccacactggatccatagaacgagggaacacaagtgtcttctcataagatttatagaaacagtgatcgttgcagaaaaataattagcaagagaacagacttcagctctctgaaggctgatgaccacctgtttctcatctcttctagtgtatgtcaaagctaaattaggtcaaataggaaataagtcagaatccccaattcgatagaaacttacaggtcttgtgatctaatctgccacttgatccgtgaattacctataggtcatccctaagaggtggcctccagcttctgcttgaattccttcaaggatggggtgctcattgtggcttttctaatcatctctgattgttagaaacactgtgaaacttttatccatcagtcctgtttctgaagctgtacggtacaaattttttttttccccacttaaggctcaactattggaatacatctaccatgtctcctatgaaacttgcttctccaggccaatcatccttacttccttaaacttttttttttcctgaaaagttattcttttaatcttattaaaaaagcaacccatgcccattccacaaatacaagtgaaatagtgaaaaacaaaaatcaaactacatctatttggtgatcattattaatgtcttatgtttcctcccagattgttttctgcatgaataataaccaacaatgtgtgtgtatgtatatatatgcttttgcattaaaaggtggttttgaaggtaa

SEQ ID NO: 126804 - DNA, 1081 bp, Homo sapiens
  Payload ID: 4860
  Gene Symbol: DHDH
  Gene Name: dihydrodiol dehydrogenase (dimeric)
  Uniprot ID: Q9UQ10
  ENST ID: ENST00000221403
  CDS Start-End: 41-1045
ctggagggaccgaaggtgccgagggctccgcatcgcaaccatggcgctgcgctggggcatcgtgtctgtcggcctcatctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtggaggtggcctacattggcacccagcacccccagcacaaggcggcggtgatgctgtgcttggcggcgggcaaggccgttctgtgcgagaagcccacgggcgtgaacgcggcggaagttcgcgagatggtcgcggaggcccgatcccgagccctcttccttatggaggccatctggacccgcttctttcctgcctccgaggctctgaggtctgttttggcccagggaactctaggagacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttctgtcgtgggaaggcgtcatgaaacaggtgtggatgacactgtcacggtgctcctgcagtacccaggggaggtccatggcagcttcacctgcagcatcaccgtgcagctctccaacacggcctccgtgagcggcaccaagggcatggtacagctcctcaacccctgctggtgcccgaccgagctggtggtgaagggggagcataaggagttcccgctgcccccagtcccaaaggactgcaattttgacaacggggcaggcatgagttatgaggccaagcacgtctgggagtgcctacgcaagggtatgaaggaaagtcctgtgattcccctgtcggaaagtgagctcctggctgacatccttgaagaggtgaggaaggccattggagtcaccttcccccaagacaaacgctgatgtatccccgaataaataaagacatcttacatcttc

SEQ ID NO: 126805 - DNA, 776 bp, Homo sapiens
  Payload ID: 4860
  Gene Symbol: DHDH
  Gene Name: dihydrodiol dehydrogenase (dimeric)
  ENST ID: ENST00000522614
  CDS Start-End: 18-746
ggctccgcatcgcaaccatggcgctgcgctggggcatcgtgtctgtcggcctcatctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtggaggtggcctacattggcacccagcacccccagcacaaggcggcggtgatgctgtgcttggcggcgggcaaggccgttctgtgcgagaagcccacgggcgtgaacgcggcggaagttcgcgagatggtcgcggaggcccgatcccgagccctcttccttatggaggccatctggacccgcttctttcctgcctccgaggctctgaggtctgttttggcccagggaactctaggagacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttctgtcgtgggaaggcgtcatgaaacaggtatgaaggaaagtcctgtgattcccctgtcggaaagtgagctcctggctgacatccttgaagaggtgaggaaggccattggagtcaccttcccccaagacaaacgctgatgtatccccgaataaataaagacatcttac

SEQ ID NO: 126806 - DNA, 634 bp, Homo sapiens
  Payload ID: 4860
  Gene Symbol: DHDH
  Gene Name: dihydrodiol dehydrogenase (dimeric)
  ENST ID: ENST00000523250
  CDS Start-End: 21-608
gagggctccgcatcgcaaccatggcgctgcgctggggcatcgtgtctgtcggcctcatctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtgggtgtggatgacactgtcacggtgctcctgcagtacccaggggaggtccatggcagcttcacctgcagcatcaccgtgcagctctccaacacggcctccgtgagcggcaccaagggcatggtacagctcctcaacccctgctggtgcccgaccgagctggtggtgaagggggagcataaggagttcccgctgcccccagtcccaaaggactgcaattttgacaacggggcaggcatgagttatgaggccaagcacgtctgggagtgcctacgcaagggtatgaaggaaagtcctgtgattcccctgtcggaaagtgagctcctggctgacatccttgaagaggtgaggaaggccattggagtcaccttcccccaagacaaacgctgatgtatccccgaataaataaagacatc

SEQ ID NO: 126807 - DNA, 715 bp, Homo sapiens
  Payload ID: 4860
  Gene Symbol: DHDH
  Gene Name: dihydrodiol dehydrogenase (dimeric)
  ENST ID: ENST00000520557
  CDS Start-End: 1-414
atctccagcgacttcacagccgtgctgcagacgctgcctcgctctgagcaccaggtggtggcggtggcggcccgcgatctgagccgtgcgaaggagtttgcacagaaacacgacatccccaaggcctacggctcctatgaggagctggccaaggacccgagcgtgggccatctggacccgcttctttcctgcctccgaggctctgaggtctgttttggcccagggaactctaggagacctccgggtggctcgggcagaatttgggaagaatctcatccacgttccccgggccgtagaccgggcccaggctgggggggccctgctggacatcggcatctactgtgtccagttcacctccatggtctttggagggcagaagccagagaagatttctgtcgtgggaaggcgtcatgaaacagctcctcaacccctgctggtgcccgaccgagctggtggtgaagggggagcataaggagttcccgctgcccccagtcccaaaggactgcaattttgacaacggggcaggcatgagttatgaggccaagcacgtctgggagtgcctacgcaagggtatgaaggaaagtcctgtgattcccctgtcggaaagtgagctcctggctgacatccttgaagaggtgaggaaggccattggagtcaccttcccccaagacaaacgctgatgtatccccgaataaataaagacatcttacatctt

SEQ ID NO: 126808 - DNA, 3917 bp, Homo sapiens
  Payload ID: 4861
  Gene Symbol: DHFR
  Gene Name: dihydrofolate reductase
  Uniprot ID: P00374
  ENST ID: ENST00000439211
  CDS Start-End: 495-1058
agtcccagacagaacctactatgtgcggcggcagctggggcgggaaggcgggagctgggggcgctgggggcgctgcggccgctgcggccgctgcagccgctgcagcgccagggtccacctggtcggctgcacctgtggaggaggaggtggatttcaggcttcccgtagactggaagaatcggctcaaaaccgcttgcctcgcaggggctgagctggaggcagcgaggccgcccgacgcaggcttccggcgagacatggcagggcaaggatggcagcccggcggcagggcctggcgaggagcgcgagcccgcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgttggtcaggctagtctcgaactcgtgaccgcaagcgattcacccacctcagcctcccaaagtgctgggattaccggcttgagccaccacacccggcacatcttcattctttttatgtagtaaaaagtataaggccacacatggtttatttgaagtattttataatttaaaaaaatacagaagcaggaaaaccaattataagttcaagtgagggatgatggttgcttgaaccaaagggttgcatgtagtaagaaattgtgatttaagatatattttaaagttataagtagcaggatattctgatggagtttgactttggttttgggcccagggagtttcagatgcctttgagaaatgaatgaagtagagagaaaataaaagaaaaaccagccaggcacagtggctcacacctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcactccagccggggtgacagaagagaccttgtctcgaaaaggaatctgaaaacaatggaaccatgccttcataattctagaaagttattttcaactgataaatctatattcacccaaataatcaagggtgaaggtaaaataatacatttttagacaagcaaagactcaggggttacctccatgtgccctttttagggaagctgttggagaaaatactccagcaaaatgaaggagtacacaaaccagagaatgacatgaatccagcaaataggatccaacacaggcaatattccagctatggagctagctttaaaaaggaacagtaaaaatattaatcggttagctgggtggaatggcccatgcctgtagtcccagctactcaggaggctcagcagcaggacgacttgagcccaagagttccagaccagcctggccaccttagtgagatcccttctcttaaaaataataacttattgccagatttggggcatttggaaagaagttcattgaagataaagcaaaagtaaaaaaaaaaaaaaaaaaaacaaggggaaagggttggttaggcaatcattctagggcagaaagaagtacaggataggaagagcataatacactgtttttctcaacaaggagcagtatgtacacagtcataatgatgtgactgcttagcccctaaatatggtaactactctgggacaatatgggaggaaaagtgaagattgtgatggtgtaagagctaaatcctcatctgtcatatccagaaatcactatataatatataataatgaaatgactaagttatgtgaggaaaaaaacagaagacattgctaaaagagttaaaagtcattgctctggagaattaggagggatggggcaggggactgttaggatgcattataaactgaaaagcctttttaaaattttatgtattaatatatgcattcacttgaaaaactaaaaaaaaacaataatttggaaaaacccatgaaggtaactaacggaaggaaaaactaagagaatgaaaagtatttgcctctggaaagaacaactggcaggactgttgttttcattgtaagacttttggagccatttaattgtacttaaccattttcatctatttctttaataagaacaattccatcttaataaagagttacacttgttaataa

SEQ ID NO: 126809 - DNA, 1447 bp, Homo sapiens
  Payload ID: 4861
  Gene Symbol: DHFR
  Gene Name: dihydrofolate reductase
  Uniprot ID: P00374
  ENST ID: ENST00000504396
  CDS Start-End: 176-583
aatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaag

SEQ ID NO: 126810 - DNA, 1474 bp, Homo sapiens
  Payload ID: 4861
  Gene Symbol: DHFR
  Gene Name: dihydrofolate reductase
  ENST ID: ENST00000511032
  CDS Start-End: 64-453
gcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataagatacccaggtgttctctctgatgtccaggaggagaaaggcattaagtacaaatttgaagtatatgagaagaatgattaatatgaaggtgttttctagtttaagttgttccccctccctctgaaaaaagtatgtatttttacattagaaaaggttttttgttgactttagatctataattatttctaagcaactagtttttattccccactactcttgtctctatcagataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagc

SEQ ID NO: 126811 - DNA, 1719 bp, Homo sapiens
  Payload ID: 4861
  Gene Symbol: DHFR
  Gene Name: dihydrofolate reductase
  Uniprot ID: P00374
  ENST ID: ENST00000505337
  CDS Start-End: 186-749
gcggccgcagttcccaggcgtctgcgggcgcgagcacgccgcgaccctgcgtgcgccggggcgggggggcggggcctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggaatgaattcagatatttccagagaatgaccacaacctcttcagtagaaggtaaacagaatctggtgattatgggtaagaagacctggttctccattcctgagaagaatcgacctttaaagggtagaattaatttagttctcagcagagaactcaaggaacctccacaaggagctcattttctttccagaagtctagatgatgccttaaaacttactgaacaaccagaattagcaaataaagtagacatggtctggatagttggtggcagttctgtttataaggaagccatgaatcacccaggccatcttaaactatttgtgacaaggatcatgcaagactttgaaagtgacacgttttttccagaaattgatttggagaaatataaacttctgccagaatacccaggtgttctctctgatgtccaggaggagaaaggcattaagtacaaatttgaagtatatgagaagaatgattaatatgaaggtgttttctagtttaagttgttccccctccctctgaaaaaaataccatttatgagacattcttgctataactaagtgcttctccaagaccccaactgagtccccagcacctgctacagtgagctgccattccacacccatcacatgtggcactcttgccagtccttgacattgtcgggcttttcacatgttggtaatatttattaaagatgaagatccacatacccttcaactgagcagtttcactagtggaaataccaaaagcttcctacgtgtatatccagaggtttgtagataaatgttgccaccttgtttgtaacagtgaaaaattgaaaacaacctggaagtccagtgatgggaaaatgagtatgtttctgtcttagattggggaacccaaagcagattgcaagactgaaatttcagtgaaagcagtgtatttgctaggtcataccagaaatcatcaattgaggtacggagaaactgaactgagaaggtaagaaaagcaatttaaagtcagcgagcaggttctcattgataacaagctccatactgctgagatacagggaaatggaggggggaaagctggagtattgatcccgcccccctccttggttgtcagctccctgtcctgtgtgtgggcggaacatagtccagctgctctatagcaagtctcaggtgtttgcagtaagaagctgctggcatgcacgggaacagtgaatgccaaacacttaaagcaattcgatgtttaagtatgtaagttcttttttttttagacagcgtttcgctcttgttgcccaggctagcatgcaatggtgtgacctcggcttactgcaacctccgccttcccagattcaagcgattctcctgcctcaggctcccaagtagctaggaccaggtgcgcgccaccacgcccggctaatttttgtattttgtatttttagtagagatggggtttcaccatgtt

SEQ ID NO: 126812 - DNA, 3927 bp, Homo sapiens
  Payload ID: 4862
  Gene Symbol: DHFRL1
  Gene Name: dihydrofolate reductase-like 1
  Uniprot ID: Q86XF0
  ENST ID: ENST00000314636
  CDS Start-End: 338-901
gagatactgatttgctcgcgctatagaattcttgtcgaagaggcttagctcccgcgggagatttcgtgcgcagttacttccggtagctggtaaaggctgatacttcccaggacgcggaggtaacgggccagggccaaagcgactttcgctacttggattggtcggcgtagctttgggcggccggaccttagaaagtcacacatctgcgcgcctgtgcggcccctgcttctgcggatgctgaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagtatgcatttttacattagaaaagggacttttgttgacttcagatctatggataattatttctaagcaacgtgtttttattcctcactaatcttggctatatcagataccatttatgaaacattcttgctataactgtctctccaagaccccgactgagtccccagcacctgctacagtgagctgccattccacacccatcacatgtggcactcttgccactccttgacattgtcaggcttttctaatgttggtagtatttattaaagatgaagatgcacatacccttcagctgagcagtttcactagtaggaaataccaaaagcttcgtacatgtatatccagaggtttgtagacaaatgttgcagccttttttgtaacagtgaaaaactgaaaacaacctggaagtccagtgatgggaaaatgaatatatttctgtcttagattggggaacccaaagcagattccaagactgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggtgtttgctgaaagaagctgctgtaatgtacgggaacggtgaatgccaaacacttaaagcaattccatgtttaagtatgtaaactcttcatacttttttttttttttctttttaagacagaatttcactcttgttgcccaggcggagtgcaatggaacaaccttggctcacggcaacttcagccttcccaggttcaagcaattctcctgcctcaggctcctgggtggctgggactacaggcgcgtgccaccacgccaggctaattttgtatttttggtggggacattccatgttggtcaggctagtctcgaactcctgacctcaggtgatcctcctgcctcggccttcaggggtgctgggattacaggcatcagccactgcacttggcagatcttcattcttttagtaaaaagtataaagccacacatggtttatttgaaatattttataatttaaaaaagtacagaagcaggaaaaccaattctaggttcaagtgagggatgatggtagtttgaaccaaaggattgcatgtggtaagaaattgtgatttaagatatattttaaagttggaagtagcaggatattctgatggagtttgactttggttttgggcccactgagtttgagatgcctttgagaaatgaaagaagtagagagagaattaaaaactggccaggagtggtggctcacgcctgtggtcccagcactttggggggctgaggtgggtggatcacctgagaccagcttgggcaacatggtggagccctgtctctacagaagatacaaaaattggctgggcattgtggcacacacctgtagtctcgtctactcacggggctgagatggaggattcaattgagcccatgagttcaaggctgcagtgagtcgtgattttgccactgcactcctgcctgggtgacagaagagaccctgtctcaaaaaagaatctgaaaacaacggaaccatgccttcagaattctataaagttattttcaactgataaatctatattcaggcaaagaatcaagggtgaaggtaaaataatacatttttagacaagcaaagactcaggggttacatgtaccctttcttgggaagctatcggagaaaatactccagcaaaatgaaggcgtacacaaaccagagaatgacgtggatccagcaaatagtatccaacacaggcaatattccagctatggagctagctttaaaaagaaacagtaaaaatactaatagattagctgggtgggatggcccatgcttgtagtcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaaaaaaaaaaacaaaaaaaaacaagggggaagggttggttaggcaataattaattctagggcaggaagaagtacaggataggaagtaagagcatcatacgctgtttttctcaacaatgggcaatatgtacatagtcataatgatgtggtgactgactgcttagcccctaaatctggtaactactttgggacaatatggggggaaaagtgaagatagtgatggtgtaagagctaaatcctcatctgtcatatcaagaaatcactatataatgtataacataatcaagaaatgactaagtagttatgtgaagaaaagaatggaacattgctagaagagttagaagtcattgctccagagaattaggagggatggggcaggggactgttaggatgcattataaactgaagaggcttttaaagattacatgtattaatatatgtattcacttgaaaaactaaaaaaatagtaattttttaaaacccatggaggtaactaccagaaggaaaaactaagagaatgaaaagtgctttcctctggaaagaacaagtcgcaggactgttttcattgtaagacttttggagccatttgattttacttaaccattttcatatatttctttaataaaaataattctatcttaataaaaagttacactcattcattaaaaaaagaattttaagactgtaataagaatcatagtttatttctgttagagaaaggcaatgtgttatacttggaaagaggtcatattaattttatcacatttttgggactcagcatctttatattttctgattttaaataaacaactttgcttatgaa

SEQ ID NO: 126813 - DNA, 4038 bp, Homo sapiens
  Payload ID: 4862
  Gene Symbol: DHFRL1
  Gene Name: dihydrofolate reductase-like 1
  Uniprot ID: Q86XF0
  ENST ID: ENST00000394221
  CDS Start-End: 451-1014
atcccagcaccctccctcgccacctcggccgcgtccagaagcgtctcattcagatagaggtacccagccgggccccaggtctcacctgggtcagcattgtcccgctgagagctttcaaacaacaggtgtacgcgaatcagtatcaaaaagcctccagggaactgaaaaaaacagtctgacttccgggattcgcgggcatccactttcattctcacgtttcctcttcaatttctcgcgagatactgatttgctcgcgctatagaattcttgtcgaagaggcttagctcccgcgggagatttcgtgcgcagttacttccggtagctggtaaaggctgatacttcccaggacgcggaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagtatgcatttttacattagaaaagggacttttgttgacttcagatctatggataattatttctaagcaacgtgtttttattcctcactaatcttggctatatcagataccatttatgaaacattcttgctataactgtctctccaagaccccgactgagtccccagcacctgctacagtgagctgccattccacacccatcacatgtggcactcttgccactccttgacattgtcaggcttttctaatgttggtagtatttattaaagatgaagatgcacatacccttcagctgagcagtttcactagtaggaaataccaaaagcttcgtacatgtatatccagaggtttgtagacaaatgttgcagccttttttgtaacagtgaaaaactgaaaacaacctggaagtccagtgatgggaaaatgaatatatttctgtcttagattggggaacccaaagcagattccaagactgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggtgtttgctgaaagaagctgctgtaatgtacgggaacggtgaatgccaaacacttaaagcaattccatgtttaagtatgtaaactcttcatacttttttttttttttctttttaagacagaatttcactcttgttgcccaggcggagtgcaatggaacaaccttggctcacggcaacttcagccttcccaggttcaagcaattctcctgcctcaggctcctgggtggctgggactacaggcgcgtgccaccacgccaggctaattttgtatttttggtggggacattccatgttggtcaggctagtctcgaactcctgacctcaggtgatcctcctgcctcggccttcaggggtgctgggattacaggcatcagccactgcacttggcagatcttcattcttttagtaaaaagtataaagccacacatggtttatttgaaatattttataatttaaaaaagtacagaagcaggaaaaccaattctaggttcaagtgagggatgatggtagtttgaaccaaaggattgcatgtggtaagaaattgtgatttaagatatattttaaagttggaagtagcaggatattctgatggagtttgactttggttttgggcccactgagtttgagatgcctttgagaaatgaaagaagtagagagagaattaaaaactggccaggagtggtggctcacgcctgtggtcccagcactttggggggctgaggtgggtggatcacctgagaccagcttgggcaacatggtggagccctgtctctacagaagatacaaaaattggctgggcattgtggcacacacctgtagtctcgtctactcacggggctgagatggaggattcaattgagcccatgagttcaaggctgcagtgagtcgtgattttgccactgcactcctgcctgggtgacagaagagaccctgtctcaaaaaagaatctgaaaacaacggaaccatgccttcagaattctataaagttattttcaactgataaatctatattcaggcaaagaatcaagggtgaaggtaaaataatacatttttagacaagcaaagactcaggggttacatgtaccctttcttgggaagctatcggagaaaatactccagcaaaatgaaggcgtacacaaaccagagaatgacgtggatccagcaaatagtatccaacacaggcaatattccagctatggagctagctttaaaaagaaacagtaaaaatactaatagattagctgggtgggatggcccatgcttgtagtcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaaaaaaaaaaacaaaaaaaaacaagggggaagggttggttaggcaataattaattctagggcaggaagaagtacaggataggaagtaagagcatcatacgctgtttttctcaacaatgggcaatatgtacatagtcataatgatgtggtgactgactgcttagcccctaaatctggtaactactttgggacaatatggggggaaaagtgaagatagtgatggtgtaagagctaaatcctcatctgtcatatcaagaaatcactatataatgtataacataatcaagaaatgactaagtagttatgtgaagaaaagaatggaacattgctagaagagttagaagtcattgctccagagaattaggagggatggggcaggggactgttaggatgcattataaactgaagaggcttttaaagattacatgtattaatatatgtattcacttgaaaaactaaaaaaatagtaattttttaaaacccatggaggtaactaccagaaggaaaaactaagagaatgaaaagtgctttcctctggaaagaacaagtcgcaggactgttttcattgtaagacttttggagccatttgattttacttaaccattttcatatatttctttaataaaaataattctatcttaataaaaagttacactcattcattaaaaaaagaattttaagactgtaataagaatcatagtttatttctgttagagaaaggcaatgtgttatacttggaaagaggtcatattaattttatcacatttttgggactcagcatctttatattttctgattttaaataaacaactttgcttatg

SEQ ID NO: 126814 - DNA, 1831 bp, Homo sapiens
  Payload ID: 4862
  Gene Symbol: DHFRL1
  Gene Name: dihydrofolate reductase-like 1
  Uniprot ID: Q86XF0
  ENST ID: ENST00000461173
  CDS Start-End: 127-690
ggtaaaggctgatacttcccaggacgcggaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagtatgcatttttacattagaaaagggacttttgttgacttcagatctatggataattatttctaagcaacgtgtttttattcctcactaatcttggctatatcagataccatttatgaaacattcttgctataactgtctctccaagaccccgactgagtccccagcacctgctacagtgagctgccattccacacccatcacatgtggcactcttgccactccttgacattgtcaggcttttctaatgttggtagtatttattaaagatgaagatgcacatacccttcagctgagcagtttcactagtaggaaataccaaaagcttcgtacatgtatatccagaggtttgtagacaaatgttgcagccttttttgtaacagtgaaaaactgaaaacaacctggaagtccagtgatgggaaaatgaatatatttctgtcttagattggggaacccaaagcagattccaagactgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggtgtttgctgaaagaagctgctgtaatgtacgggaacggtgaatgccaaacacttaaagcaattccatgtttaagtatgtaaactcttcatacttttttttttttttctttttaagacagaatttcactcttgttgcccaggcggagtgcaatggaacaaccttggctcacggcaacttcagccttcccagctactcaggaggctaagcaaaaggatggcttgagcccaagagttcagagcagcctggccaccatagtgagatcccttctcttaaaaataataggttattgccagatttggggcatttggaaagaagtgcattgaagataaagcaaaagtaaaaaaaaaaaaaaacaaaaaaa

SEQ ID NO: 126815 - DNA, 591 bp, Homo sapiens
  Payload ID: 4862
  Gene Symbol: DHFRL1
  Gene Name: dihydrofolate reductase-like 1
  ENST ID: ENST00000496983
  CDS Start-End: 249-591
aaaacaaatctcagccctccaagagctggagggagtgggtactagaagtctgcgagctggacggaagggactcagcattacagcactcagcattatttcagggcttgacagtaaagccaaagaaacgctgatctcgcgaggggacgaacaaaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttgga

SEQ ID NO: 126816 - DNA, 1802 bp, Homo sapiens
  Payload ID: 4862
  Gene Symbol: DHFRL1
  Gene Name: dihydrofolate reductase-like 1
  Uniprot ID: Q86XF0
  ENST ID: ENST00000619045
  CDS Start-End: 127-690
ggtaaaggctgatacttcccaggacgcggaggcacgtaaaaaaatttgaagaagggaatttcgcggcattcttggcctggcttcctggcgtagccagcaagttcggaggtgttaaccgctgctgtcatgtttcttttgctaaactgcatcgtcgctgtgtcccaaaacatgggcatcggcaagaacggggacctgcccaggccgccgctcaggaatgaattcaggtatttccagagaatgaccacaacttcttcagtagagggtaaacagaatctggtgattatgggtaggaagacctggttctccattcctgagaagaatcgacctttaaaggatagaattaatttagttctcagcagagaactcaaggaacctccacaaggagctcattttcttgccagaagtttggatgatgccttaaaacttactgaacgaccagaattagcaaataaagtagacatgatttggatagttggtggcagttctgtttataaggaagccatgaatcacctaggccatcttaaactatttgtgacaaggatcatgcaggactttgaaagtgacacgtttttttcagaaattgacttggagaaatataaacttctgcctgaatacccaggtgttctctctgatgtccaggaggggaaacacatcaagtacaaatttgaagtatgtgagaaggatgattaatatgaaggtgttttctggtttaagttgttccccctccctctgagaaaagtatgcatttttacattagaaaagggacttttgttgacttcagatctatggataattatttctaagcaacgtgtttttattcctcactaatcttggctatatcagataccatttatgaaacattcttgctataactgtctctccaagaccccgactgagtccccagcacctgctacagtgagctgccattccacacccatcacatgtggcactcttgccactccttgacattgtcaggcttttctaatgttggtagtatttattaaagatgaagatgcacatacccttcagctgagcagtttcactagtaggaaataccaaaagcttcgtacatgtatatccagaggtttgtagacaaatgttgcagccttttttgtaacagtgaaaaactgaaaacaacctggaagtccagtgatgggaaaatgaatatatttctgtcttagattggggaacccaaagcagattccaagactgaaatttaagtgaaagcagtttatttgctaggtcataccagaagtcatcaatcgaagtatggagaaatggaactgagaaggtaaaaaccagttcaaaatcagtgaggaggttctcaatggtaacgagctccatactgctgagatacagggaaacggaggggagaaagctagagtatttaacccccactccttggttgtcagctccctgtcctgtgtgtgggcagaacgtactccacctactcaatagcaagttccaggtgtttgctgaaagaagctgctgtaatgtacgggaacggtgaatgccaaacacttaaagcaattccatgtttaagtatgtaaactcttcatacttttttttttttttctttttaagacagaatttcactcttgttgcccaggcggagtgcaatggaacaaccttggctcacggcaacttcagccttcccagctactcaggaggctaagcaaaaggatggcttgagcccaagagttcagagcagcctggccaccatagtgagatcccttctcttaaaaataataggttattgccagatttggggcatttggaaagaagtgcattgaagataaagc

SEQ ID NO: 126817 - DNA, 1521 bp, Homo sapiens
  Payload ID: 4863
  Gene Symbol: DBT
  Gene Name: dihydrolipoamide branched chain transacylase E2
  ENST ID: ENST00000370131
  CDS Start-End: 1-963
atggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaagtattacttctcatggaaatcttaagatcaacatgtcagtgaggaaatcacctagaatttagacattttctttggaactttggctggtctgtatcattattttgaaaatctccttgatgtttacaagctacctgactactttatcttttattctttaatgattagggtgacctagttccacatggcctgaaggtaacattggcagtaatgtgactaggtacatgtagacttgaaattaaactcagcataaataagagttctctctctccctccttttatacctcttattgtttcaaattctctatcctttctaagttaaaagtactaaaattgcattctttttctgttaaacaggctgcttccttgggattactacagtttcctatccttaacgcttctgtggatgaaaactgccagaatataacatataaggttggctatgcagagtaaaaatgttcttattattaatagaagatggggcaaatgtgcttgtagattagagacttctattgtacctcaaatagtgatcttttttagactagaattaaaggtatggggtaaaacattaaacttaagtctaatt

SEQ ID NO: 126818 - DNA, 10799 bp, Homo sapiens
  Payload ID: 4863
  Gene Symbol: DBT
  Gene Name: dihydrolipoamide branched chain transacylase E2
  Uniprot ID: P11182
  ENST ID: ENST00000370132
  CDS Start-End: 15-1463
atttccggggtaagatggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggctgcttccttgggattactacagtttcctatccttaacgcttctgtggatgaaaactgccagaatataacatataaggcttctcataacattgggatagcaatggatactgagcagggtttgattgtccctaatgtgaaaaatgttcagatctgctctatatttgacatcgccactgaactgaaccgcctccagaaattgggctctgtgagtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcaagattaacaaaattaggccgggcatggtggctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatacagacagtatatgccctattttttttaactgactcttaatgaaactttaattttacttaattaagaaatggaatttatatacaaaaatattttccatttccgttattatgctaattgttgtatgaaataagtgcaattatacttctcttttgagatatccaagagtatattcttgctctgtatagagaatatcatctgatagtgtcttatttatattaattaatgtctttgaaaagggaaaagtataaactggccttaaaattgtccaattatagttttataaccagtctattaaaggtgtttgtttaaaatggatatagttttagatttgtggtaatgctttggtattttcttggggaagaccttcacctttgcaaacttccctcatgtaaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtaaataagaggagaaggaagagtctaatagtaattatggatataaaaaataagaaattttgtatagaaatgaaggtttcataatgatcattttgttaaaggtctactttaatcagaaatagcaacgagatgaatgtatccaacatttcaatttgcattcggaaatccatgttgtttctaatattgtccagttgaaaactgtatgccaaaattagttgtttaagtgaagttttgtgacagaaaaaaggttgttttaatatctacttggtttttctcaaaatggaaataattttaaaatcaggaaagaataaatcagccaggtgtgatgacttgtaactgtaatcccagttataggggaggctgaagcaggaggatcacttgaggccaggagtttgagaccagcctgggcaacatagtgagatcccatctcaaaaaacattatttttaaaattagcctggtggctcacgcctgtaatcccagcactttgggaggccgaggtggccagatcacctgaggtcaggagttcgagaccaccctggccaacatggtgaaaccccatctctacagttttgtaaaaatacaaaaaattacctgggcctggtggcacacgcctgtagtcccagctacttgggaggctgaggcaggagaattgcttgagcccaagaggtggaggttacagtgagcagagatcacaccactgcactccagcctgggtggcagagcaacactttgtctcagaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaaataaaataaaataaaaaaaacaggtcaaataaatgctgttgttgtaaaatttcagataatacaaagagttaaccaataaaagaaaaagtcattcataatcttaccactattaacattttgatgtatctatctgtatgtatggctattcttttttgttaaaacatgatcatagcatatctactattttattatttgatttttaaaatttaacattatattatgggtaaccttacatgtcaataaacaattccacattgtcatgctttaaatggctgcataggctgggtgtggtggctcacgcctgtaatcctaccactttgggaggccaaggcaggtagatcacaaggtcaggagttcgagaccagcctggccaatatggtgaaacctcatctctattgaaaatacaaaaatcagccaggcacggtggcaggcgcctgtagtccacctactcgggaggctgaggcaggagaactgcttgaacccagcggcagaggttgcagtgagccaagattgagccactgcactccagcctggtgatagagcgagactctgtctctaaataaataaataaataaataaatgtctgcatagtattccattgtatgcatttattatacattcaaacattaaacatctaccataccaatcatggttctaagcatacagtagccaccttcatgcttccttgattgggcttacagtctagtaaggagacagatattaaataactgcataaaacactgttcttggtaggtaataacccagatgctatgagccatccagtaaaggttaccgatcttatctggaaggatcagaagatggatgtcccataatttaaccaattatctattgataggcatttattgagttttaaatgaataatgacatgatcaataaaaatgtcctcctcacttaaagaatagaaaaaccaggagaagggagttctgaaataagtaagtatgtaggtccagcatcaatggctcaagatactctattcccaaataacccttaagttatctggttctattccaacccttgggtattactatcttctctttggtctcatgcattgagaattcagcaaaggatttgttccctacagtgtgcacggcccttaggatagcaggattccctgaagagggccaaaggggcaggagcgcagccttagtggcagtgctggtccatgaggctctacaaagcaagggatgggtgtttgggaggaggaaaaggctcttgctgtactcctagaggttggaattaaagtggaaaagccagaaaattcaagtcctttactaacatgtctggagattagaaggtatatgtacatgggggagaagccaaaattattgctgcgagtggtcagcaagaaaatcaaggctcttttcattattttgagcattcctctgatatttgaaaaggaagtacaacaggaaaggaagtctgaggatggaagctaaaattggtatgaatttatattttagagatcaaaatgtaccttatgttgaaacctatgtaagaagtgattatgtagaaagagtgaaagtgatagctcttagtctggaaagcccactggcttgtttgggcatttctcatggcttcccactcaaagtggatccccaaaatcacttgatggatttccttgctgatttctaagtaaactatggtttaagaaagaaatgacagggctcagcactgccctacagtaccaagaatacaaatgtttccatgaagtcttcaaaggcatttgtaaaattcaggctgtaagtgattagttagttcattctgcacttatttattaactgtatattcagttccaggctctagggtagagattatggataaaggtgaattagatagatgaagtttttgccctcacagcaaaagctttagccaataattaaagctatcactggaagtgggtctgtgccaataacctagagaagagcagtgcttttagagttgagctatattcccaatcagttcttaatggtggttttacccccttccctctacactgtcttttcttgagattggatcatgtgtgtgaacccacatcatttccagtcaaaatcaccaagagaggccggacacagtggctcatgcctataatcccagcactttgggaggcctaaatgggtgggcctcttgagtccagagtttgagaccagcctgggcgaccccagctctaccaaaaaaaccaaaaaacaaaaaataccaaaaaaaaaaaaaattaggccgatgaagtgacatgcacctgtgtgccacctactcaggaggctgaggtggcaggatcacttgcatctgggggcaaaggctgccgtgagctgagattgtgccattgcgctccagcctgggcgacagagcaagactctgtgtgtgtgtgtgtgtgtgtgtgtgtgtgtgtgtgtgtgtgtgtgtgtgtgtgtgtgtatacacacacacatatatatacacacacccccaggagaccttttgtctttcttggttcatgtgcccatcagtgtgggcaggagaatagaatactctgtccacacttgagtcttagtcacctttggagcctaggagtcagccatcctcattcaactacatggatcgagaatgggaatctgggagaatttttttatgggcagattaaaaaggaagttaactatgtaaagtaaggcattgccttcccaccccatcccacctcagttcgtgttaaattatgaatttttctaagagagttctttaatgacatggatagagaggaagctgaggtggcagtagagtagggagtggaaggcaaatacataagatactattaaactgtgaagctgtttgttacaattccaagattttataatttctccaacaaaaaacatttgtattttcttcccagtttaagttcaatgttaatttgagaaataattctactctcaaacttcatgttatgctgacagttcaactgatgctgtcaaaatgtgaattactaacttcagtattctctattcatctgatttttcttaaaatgtttgcgtgttaatatactcactagctttaatgctctactcttatactggcaccttaattatggtaaaaggtaaaaggttaagttaaaattcccaatcctagttatttggtcaaacagaagattaacagaactccatggcttaccacaggaatatttatcaagagaaaaagaagatacctatttgaatttacatgacactttctgtgaaatatctggattaccagattagtctgaaacaaatgccttccaaattctacagcgcatgcccaaggcactctttacagtacctgttcgggtcttttcttctaattttaagcacctacccaaacgtcttcccaggcttgtcataataagcaaataacctcagagcagacaaagtgattcaatctaagaaccttgaatttctctccttttcacctcaaaatttctattctcacactttctttttgtttctctttccgagaagtggttctccatcagcaaataccaactgttttctgtcctctattatttattccatctcttcctcctgatccctgccccatgttgaacccccattgccccactttgatccttcagtctcttcctcacatccagaactgtaccagatttactcccttagcacactgattaaaatttatttccatttccttatggaggaggtattagagactgatcccagacctctacaaatttcattgtggcagggtaatgttatgtgtccataaaccttgttccttttctttcagcctgcagttaggtagagccatgtcatttatttgtaactattagaatatgggtatatgggttgaagtaatgtaggccatttccagacatggcccataacacttctcaagagattcttcatattctatctcttcccctccaacatgcacccttcaaggttgaagatggcaccacacaagatagaaggagccagtgttccaaatgactaggcagagcagaatgctcccctccctacaccctagcaccaattggtttggatgtgatagttgaataatacacttttattgttttaagacattaatattttgagattaatctgcaagtctagttagtaaaactcgaactctgagctgtctaatgcagtagcctctagccacatgtagctatttaaatttaaattttaattttaattaatcaaaattcaactcagatatactagccacatttcaattgctcagtagccacactaattaaatttaaatttaaatagctacatgtggcttatagcaccataccagatagcacagatgtagactgtttccatcatcacagaaaattctattggatagtgctgccttaactaataagacacaaatgttcttattttttaaatagtccctaaaacaaacgaaaaacaaagaactcccttctctaatggcaaatttcagtttgcctaaaagaagactcagaatgcttttcttatattgttacctctgactgccactaaatgaataaatttcctgtcttgctccttctgccaaacttcttgaatgggtgatctttaactccttgcaatcctggcttttttccccagtgctcacctgtaatcagtgttggccacaactcccacccagatgtctcctaaatagttctctgaacccacctctgtcctgatctacagacattcattccaatgctttagcatttcaaggtcatcaaatgactcagtgacatctcagacagtcagacagaccaggtcaactatgaactatttatgccaaaccttacatggttcatgttatccttgctatcccatcaaaataaccacaggctttttttttttttttttttaatttttgagatggagtctcactctgtcaccccgactagagtgcagtggtgcgatctcggctctgctcactgcaacctccgtctcctgggttcaaacagtgctcattcctcaactcccaagtagctgagattacaggcatgcaccatcacgcctggctaatttttctatttttagcagagatggggtttcgccatgttggccaggctggtctcgaactcctgacctcaagtgatctgcccgcctccacctcacaaagctttgggattacaggcatgagccacggtgcctggcctgcagcctcctttattttacaaaaggcattaccacttaaacactgaagatagcacgaatctctgatgtttgcaagttcagaataaaatggaaatgaaaattcattatgtggcagtctcagtactgagcacaaaggcttttaaccacaagcaaattactgtgctagccagaccgtgtgagagaactccaggccagcttgctaaaactgagcaggagaatttggagagagtccagaggagagccacagaaacaactgaagcatgacaagaataattgcagttctgttatagagaggtcatctatatcaggcttttatggagtaccatgtggaatgttaccacgcagagcatggggaacagctgttgtgactcaacaagagacaggacagaagaaatgagaacaggtggaagatcaataatttaggtttgatatggggaaagatggaacagtcaaagggattcacactgatttttggctgagcagaaggcagagtctcctccaacgggcaatgtaagtgcccccactcatctacaccccgagaagagccatcaaactgtattaaacttggaaaaagctatttaacttcaagtgtgctgcgagaaaacttcataatagttcctaagatgtgctaaaaagtaaagtccaaaaagatcataaagtctgtagagaagttctaagagtgcagtcagctataaaaacctagcaatttaatttcttagaaaaatgtagctggagttcaaactgtagtaacaaaggcaagtaaattaagttgtgggcaggtgtaattaagttaataggaatggcagggatgaatataaatcagaacaggactaacagtttgaaacattagatattcaaatgctcagagctgatgagccgagccactacgctaacaactctgcaaaccaaaggtttcacaaattgcacaagaacctggcctcgatcccattgtgttgctggcataagattagaagggcctgttggttcaattgttgctttggacagaggaggacaaacttgccacagtgaagaaatcatttttaaaaaccaccactgtcctttagtgcactaatttctctaataactaggtgtatattagaaataatgatatataagtgcagtatactccagtttcaacagaatggtgtcacttctgtaaaatgttgattttcagattgtcatactttctaaatacaaaaatttgtcacagcttccacatttacaagatattaaacattccataaaatatttgtagaaatatgaaaaaccaatttttgtagttgccttttgaaatgtatacaaaatatcccacatgggcaacatggtaaaacctcgtctctacaaaaaaaaaaaaaaaaatacaaaaagttagccaggcctggtggtgcacgcctgtggtcccagctactcgggaagctgaagtgagatcacctgtgcccaggaggtcgaagctgcagtgagctgtgattgcaccactgcactccagcctgggtgacagagtgagactttgtctcaaataaacaaaaagagacatatacaaaatatattagaaagttgggttaatatcctacaaacaaagtattacatagtttgcacaggattatgtgtgtaaaaagttttaaattcagtatagcttttatttctgcagaactaaaagtagtgcataaaaataaaagtgggatgagcatatctttttaatttgctatgcagtaaaaagtatctcagtcaacatataggaaaccagtgccatttctgtatcatttgacaccgaaggggtattgttttttgttttgttttgtttttcttttgaagaaagacttttatgtcttttattctattcttccgatttggggtttaaattacccccaataagtttgcagaatattctgattactactgcttaggtgatatatttcatatgagaactatctttacacaatgggaaaaaatatggtaaccacttcattcatcagagaagttgtgttttgtttacttgtattttgtttgctaaatgaaattggttatttagactcatggcatgctttttctcaaatggagatttaaaagtcatttccaatgtccttctaacttctggccaattcccagtaggctatagaataaacagttttcatataatagtc

SEQ ID NO: 126819 - DNA, 3755 bp, Homo sapiens
  Payload ID: 4864
  Gene Symbol: DLD
  Gene Name: dihydrolipoamide dehydrogenase
  Uniprot ID: P09622
  ENST ID: ENST00000205402
  CDS Start-End: 282-1811
agtataagaatacattgtagctcgacattttggcaccagcccctaaagcattcccaccaccacccccgctgcgacaaagccctgcgctccttacgacagcgtacgacgccgagcctgacaggaacgcctcgtgcggtagaaccgcgcgggccaatcgcgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaacggtctctcacttgttttatttaacctctaaattctttcattttaggggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatgtatctttattttcatgttataggacaatattaaggcattttaaaggtcatcatcctttcatctattttagatacacctactaaatgtttaatatatacttttggagaagtacaacataagggagtctttaatctgtgttttccttggctgggttaatgactgtttatttaaagagtgttgtaaaattggatgtgtggtgtttaaaatggccatgtcctgaggaaacttaagtaacaaagtactaaatgctaagtaggcttttgcatattgtaactaaatttaagaataattcagattaagtagttctgaaatttggtatagatagcatagattgtctcatgctcatgagtgacataatgaccctggattctgttacatacttctaaagaaaattgattgttgtcttaggaggcagttaacttggctgaacaccaactccacactctgtcttgtttgtaggtggcagcagctgaaatctcttctcagttgttttagctttagctatgctgctggaagtctttcccatgcaagtgtgtagttcaggggtcaaccagagtttgggcagaaggaagtctgccccttctgtgcctcctgttttttgggggtttcccctttatgttccagctgttgtggttgccccatattctgccttctgatccttaaccaataaaacttggcttttgtttccccctcaagtgagaacccgttaaaaatgagacattgagccagtgctgttcactttttaagtgccaacttccctctactttccacttgtttatagttgtttccagtgcctttagttttttctaaaatatatttgttcagagtttgcagttgctatcagcaggagggttggtctgatatctgtgtgctactttgccattattggaagtgaactctgcatctttttaaaaatttgaaatcccggtatcatgtgaagtgctgtttatgtaaatctcaacatatcccttactcagggaaaaaaaagtttttagttagggaatagtgaaatataatttaatatggaattctagctgtagagttaaatccatctttaagtgtttacattcagtatgagaatgcaaatttatctgtatggggaataaagtcctaggaataaaacaagttttaagtgttcacttac

SEQ ID NO: 126820 - DNA, 1859 bp, Homo sapiens
  Payload ID: 4864
  Gene Symbol: DLD
  Gene Name: dihydrolipoamide dehydrogenase
  Uniprot ID: P09622
  ENST ID: ENST00000437604
  CDS Start-End: 78-1463
aggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataagatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatc

SEQ ID NO: 126821 - DNA, 930 bp, Homo sapiens
  Payload ID: 4864
  Gene Symbol: DLD
  Gene Name: dihydrolipoamide dehydrogenase
  ENST ID: ENST00000451081
  CDS Start-End: 66-413
ggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaacattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatct

SEQ ID NO: 126822 - DNA, 2041 bp, Homo sapiens
  Payload ID: 4864
  Gene Symbol: DLD
  Gene Name: dihydrolipoamide dehydrogenase
  Uniprot ID: P09622
  ENST ID: ENST00000417551
  CDS Start-End: 88-1617
atgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaagcatttgtcttcaacagaatgtcttcagcactttgttttgcctcatctgccctcagttttgcttcagagacctaaatatgaagaataaattacccagggaagactttcattctttctaaaggagaccagaatattggaaatggctcaaaaatgatgttgaaaaactatgtacttggaatcatatgtctgggaaacaactttctcccattcaacaaagtattgtatcttacagactgcaagtattcagtatagagattcctaaacagtattctgatataaatagaactagcatttaaaattt

SEQ ID NO: 126823 - DNA, 1802 bp, Homo sapiens
  Payload ID: 4864
  Gene Symbol: DLD
  Gene Name: dihydrolipoamide dehydrogenase
  ENST ID: ENST00000415325
  CDS Start-End: 88-264
atgcgcagggaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgagctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttg

SEQ ID NO: 126824 - DNA, 682 bp, Homo sapiens
  Payload ID: 4864
  Gene Symbol: DLD
  Gene Name: dihydrolipoamide dehydrogenase
  ENST ID: ENST00000450038
  CDS Start-End: 66-410
ggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtattccttctaaggctttattgaacaactctcattattaccatatggcccatggaaaagattttgcatctagaggaattgaaaacttataaccatcgtaaagtgttcagaggatatgttatcacagtgggatataatgttttattttggactgcctttttacccaagcattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataag

SEQ ID NO: 126825 - DNA, 1993 bp, Homo sapiens
  Payload ID: 4864
  Gene Symbol: DLD
  Gene Name: dihydrolipoamide dehydrogenase
  ENST ID: ENST00000440410
  CDS Start-End: 79-1539
gaggggagaccttggcggagcggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaaggctttattgaacaactctcattattaccatatggcccatggaaaagattttgcatctagaggaattgaaatgtccgaagttcgcttgaatttagacaagatgatggagcagaagagtactgcagtaaaagctttaacaggtggaattgcccacttattcaaacagaataaggttgttcatgtcaatggatatggaaagataactggcaaaaatcaagtcactgctacgaaagctgatggcggcactcaggttattgatacaaagaacattcttatagccacgggttcagaagttactccttttcctggaatcacgatagatgaagatacaatagtgtcatctacaggtgctttatctttaaaaaaagttccagaaaagatggttgttattggtgcaggagtaataggtgtagaattgggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttctattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaatatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagagggtattgagtacaaagttgggaaattcccatttgctgctaacagcagagctaagacaaatgctgacacagatggcatggtgaagatccttgggcagaaatcgacagacagagtactgggagcacatattcttggaccaggtgctggagaaatggtaaatgaagctgctcttgctttggaatatggagcatcctgtgaagatatagctagagtctgtcatgcacatccgaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattc

SEQ ID NO: 126826 - DNA, 4458 bp, Homo sapiens
  Payload ID: 4865
  Gene Symbol: DLAT
  Gene Name: dihydrolipoamide S-acetyltransferase
  Uniprot ID: P10515
  ENST ID: ENST00000280346
  CDS Start-End: 660-2603
acaaacctgaaacgaaatctttgcaaccagtacagcctgcgcggggcgcggcccagtccatcccccttcggatgcgcagaagcagaggtcaccacgccggacccctcgattccctcgcgggcgattcctggctccttcaccaccccagcactccaagacccccgccctttggcctgaggctcccactgccctagccagttcccgggctcacttccagcttttccagaaagcttggccacgcccctcggcccagactctcaggccactcggccgcaattaacccgcgtctctgcgcctttttaggcccctccccctcggtcgtgcccttgtcatctcttaggccccgtctcaccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaa

SEQ ID NO: 126827 - DNA, 3517 bp, Homo sapiens
  Payload ID: 4865
  Gene Symbol: DLAT
  Gene Name: dihydrolipoamide S-acetyltransferase
  ENST ID: ENST00000393051
  CDS Start-End: 34-1662
gttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaaattatttatgactacttaaaatgaatctgaccagtgcttcctggtatatgtaatatgtggagttagcccctgaaatttgctttaagtgtttcagtgttgaatctgtttctaaatattcattattacatggtacacaagtgacactccatatattccacacagacttttaccttgctgtattattatgaaaacaatacattaatttgatttttcagtaattagtaattttaggttgaagattatccaaaagaaacaagcttatcacaagggaccatcatcaatatgatccaaatctggttcaaacattcaaaacttcaaagataattcatctttcgctaatgcttgtggttctgttgttcccttgaaaaaaaataaaaacagttgccttctaataaacattgttgagttaaaaattaatctgagctataatctaaatcgattcagtctcttaccagaactgaaagaaaaaagttagaaatagtgtttttggttcatatgattatttaaaaattaaagtataaatcttcaa

SEQ ID NO: 126828 - DNA, 1766 bp, Homo sapiens
  Payload ID: 4865
  Gene Symbol: DLAT
  Gene Name: dihydrolipoamide S-acetyltransferase
  ENST ID: ENST00000531306
  CDS Start-End: 1-1440
cccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagac

SEQ ID NO: 126829 - DNA, 2118 bp, Homo sapiens
  Payload ID: 4865
  Gene Symbol: DLAT
  Gene Name: dihydrolipoamide S-acetyltransferase
  ENST ID: ENST00000533297
  CDS Start-End: 66-263
gctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaa

SEQ ID NO: 126830 - DNA, 1464 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000238671
  CDS Start-End: 39-242
atatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcagatgacttggttacagtcaaaaccccagcgtttgcagaatctgtcacagagggagatgtcaggtgggagaaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaa

SEQ ID NO: 126831 - DNA, 2838 bp, Homo sapiens
  Payload ID: 4866
  Gene Symbol: DLST
  Gene Name: dihydrolipoamide S-succinyltransferase (E2 component of 2-oxo-glutarate complex)
  Uniprot ID: P36957
  ENST ID: ENST00000334220
  CDS Start-End: 62-1423
acttccggttgttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttttccctagtgctggtatactatagagaaacccctggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaaca

SEQ ID NO: 126832 - DNA, 563 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000556460
  CDS Start-End: 64-378
ccacttccggttgttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccac

SEQ ID NO: 126833 - DNA, 718 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000555988
  CDS Start-End: 1-224
gggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagcctttgattgtcttttcagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtggtaaagaagttctcctggtggtcaagctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgag

SEQ ID NO: 126834 - DNA, 1479 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000554612
  CDS Start-End: 40-153
tatatccggtgtccgcccgccctcggctcctccgccgtgatgctgtcccgatcccgctgtgtgtctcgggcgttcagccgctcgctctccgccttccagaaggggtctccttatgccagggaccaggttaccctaacagcaggaaggttgtaggatgacttggttacagtcaaaaccccagcgtttgcagaatctgtcacagagggagatgtcaggtgggagaaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatctta

SEQ ID NO: 126835 - DNA, 837 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000554806
  CDS Start-End: 1-837
gctgtcccgatcccgctgtgtgtctcgggcgttcagccgctcgctctccgccttccagaaggggaactgccctctagggagacgttccctgcctgcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcct

SEQ ID NO: 126836 - DNA, 569 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000555492
  CDS Start-End: 52-384
gttgtccggccctatatccggtgtccgcccgccctcggctcctccgccgtgatgctgtcccgatcccgctgtgtgtctcgggcgttcagccgctcgctctccgccttccagaaggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatg

SEQ ID NO: 126837 - DNA, 1078 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000555089
  CDS Start-End: 14-265
ctcctccgccgtgatgctgtcccgatcccgctgtgtgtctcgggcgttcagccgctcgctctccgccttccagaaggggaactgccctctagggagacgttccctgcctgcattaacaacagtgtcttcagtgttcgctttttcagaactacagctgtatgcagatgacttggttacagtcaaaaccccagcgtttgcagaatctgtcacagagggagatgtcaggtgggagaaaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacagcctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggg

SEQ ID NO: 126838 - DNA, 252 bp, Homo sapiens
  Payload ID: 4866
  Gene Symbol: DLST
  Gene Name: dihydrolipoamide S-succinyltransferase (E2 component of 2-oxo-glutarate complex)
  ENST ID: ENST00000626051
  CDS Start-End: 1-252
atgctgtcccgatcccgctgtgtgtctcgggcgttcagccgctcgctctccgccttccagaaggggaactgccctctagggagacgttccctgcctgcattaacaacagtgtcttcagtgttcgctttttcagaactacagctgtatgcagatgacttggttacagtcaaaaccccagcgtttgcagaatctgtcacagagggagatgtcaggtgggagaaaggttccatcaccagcaaatggcgtgattga

SEQ ID NO: 126839 - DNA, 2426 bp, Homo sapiens
  Payload ID: 4867
  Gene Symbol: DHODH
  Gene Name: dihydroorotate dehydrogenase (quinone)
  Uniprot ID: Q02127
  ENST ID: ENST00000219240
  CDS Start-End: 22-1209
gggcttaatgacggaaggagcatggcgtggagacacctgaaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccattt

SEQ ID NO: 126840 - DNA, 607 bp, Homo sapiens
  Payload ID: 4867
  Gene Symbol: DHODH
  Gene Name: dihydroorotate dehydrogenase (quinone)
  ENST ID: ENST00000574309
  CDS Start-End: 1-581
cgtggagacacctgaaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagagagcagggctttggcggagtcacagatgccattggagcagatcatcggaggtgaggacagcgtctgacgggaagcctgatctggaaccttccc

SEQ ID NO: 126841 - DNA, 4824 bp, Homo sapiens
  Payload ID: 4867
  Gene Symbol: DHODH
  Gene Name: dihydroorotate dehydrogenase (quinone)
  ENST ID: ENST00000572887
  CDS Start-End: 178-1359
gtgcacccaaccagaacctgggggtggtgccgggccttccccgctgcgcggaggcgtcctctcaacccttctgcccggcgactggtgggttggcggctaaggggcggagacaagaggggccgccaccatctcctccaatggaagggagacaggggcgggcttaatgacggaaggagcatggcgtggagacacctgaaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccatttactttcttcactattcttatgtggcatggttcatgctgggcctcggtcttttgagtggggtctgtttacccagtcccctgttggtgatcacatcgctaacttccggcgttttcctatcaccatcggtgcctccgtgaacaccttgtgaatgtgcctgtgccttcgttctggtgtcggtgcagagcagggtccaaggggcgtgacagctgggctgaggggctggcatgtttcacattctgatagatagagccaagttgctcctatcaggttttcaagctgcccatttcccaccgtggagacagcaacagaggggacatccccagctcctctggctctgcctgttcaaagctaccctgtgaggcctgaagacagagctgccctgaaggcagctcatgtccactgaacactgactgtgggctggatgctgtgccaagggcttgacgtttcctctttaaggatgaggaaacgggcagagaagcggctgattgtccagtccccctgcgtggaggctgcttggctgggctcgagcccagcggtgtggtcatagagcatgttgtgctgaatggctctgccatggaccaagccttggctgctctaaaagccggctcattgccttctgcttctccggattcgttccttactccaggaagagcagtgcactgaaggagaaatgggaatgggcaaaaggaaccacatgctggccagacccctgcggggtcactttcctcagcctgggctccgacatgccacgtcaggtgccagcgcacatactctggacaccctcctcattctctctgggctttgatgctctctgtgagtcatctgccctccctttcccatgctacaggcatctaccttgctctgtcccacctaatagcttcaggactgaacaattcaggaaagggaagggaaggggtggaggagaagagggaagagtcggcccttggaaggttctccacggaagactgccttttttttttttgagatggagtctcgctgtgtcgcccagcctggagtgcagtggcatgatctcagctcactgcaaactccgcctcctgggttcaggggattcttcagcctcagcctccagagtagctgggactacaggtgcatgccactgtgccctgctaatttttgtatttttagtagagacggggtttcaccatattggccaggctggtctcgaactcctgacctcttggtccacccgcctcagcctcccaaagtgctgggattacaggtgcaagccaccgcgcctggctcgagagactgacattctgtctcagcacagctggaagaggctgcttgagcaccaggataaggagttgtcttgcattcaggggccatgtggtgtgcggatacctatttttctttcttttcttttttttttctgagacagagtctcgctctgtctcccaggctagagtgcagtggcatgatctcagctcactgcaacctctgtctcccgggttcaagcaattcttctgcctcagcctcccaagtagctgggattacaggtgcccactaccacacccagctaatttgtgtgtgtgtgtgtgtgtgtgtgtgtgtgtgtgtgtgtgtgtgtgtgtgtttttgagatggagtcctgctctgtcaccccggctggagtgcagtggtgcgatctcagctcactgcaagctccgcctcccgggttcacactattctcctgcctcagcctcccgagtagctgggactacaggcgcctgccaccatgcctggctagtttttttgtattttaagtagagacagggtttcaccgtgttagccaggatggttcgatctcctgacctcatgatctggccgcctcagtctcccaaagtgctgagattacaggcgtgagccagcgtgcctggctaatttttgtatttttagtagagacggggtttcaccatgttggccaggctggtctcgaacccctgacctcaagcaatccacccaccttggcctcccaaagagctgagattacaggtgtgagccaccgcacccggcccaaggatacctatttttcttaatgctggaagccacactcagacaccagagcagctctcaatgctgggaatcctgggagactgatgatgaccgcgtctccctctgggaccaaggatggtggaagggtgtgcagaattccaaatgttatttacatcactcactcttgtgtggagtgcataattgtctttgcttgccaatttcatatcagttaaatataagcagtaagctaatccta

SEQ ID NO: 126842 - DNA, 839 bp, Homo sapiens
  Payload ID: 4867
  Gene Symbol: DHODH
  Gene Name: dihydroorotate dehydrogenase (quinone)
  ENST ID: ENST00000571288
  CDS Start-End: 1-230
acctgaaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggcatgttagaatcccccgggggtgcacttggaatattcagatgccctggcctggtgccagaccagtttcaccgccacatctgagagcaggacctgaaagctgccaggggcctttgtggtgcagctggagctgagaaccacggtcctggaggaaggcccctacacatcttgcctaccagtctcctgaggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtggggatcaatatcttcagaattggccaggcaaaatatatttgcttaacattcagctgctacagataactgcaggtgctgggatgatggtacttggtgaatcctataggtgagcaggggtgtgagatcctgctctgagccctgtgtgtgcggcctcctggttgtgtggcatgtggtatggatttaacagtcacgggctttcagtggtggaacacaggttacgggccagac

SEQ ID NO: 126843 - DNA, 843 bp, Homo sapiens
  Payload ID: 4867
  Gene Symbol: DHODH
  Gene Name: dihydroorotate dehydrogenase (quinone)
  ENST ID: ENST00000576145
  CDS Start-End: 411-843
gagcagtgtggatgggggaccagggaccggggagggcgagaacggagagtcaggccgggcgaggcatggaccgaaggcggctccgggagtgtgggcccccctgggacgtgtgcgtgtttccggggtctcctgcaaatgctcgtgcgtgtgcatttgcacgtggactcggtcaggcgtgtgcagacagcgcctgcaggtctgggtgggtgctgatctgagtgtctgcgcctgggccatgtttttgagcctggcacaggggtgcttagtgaacacatgaccgcctagcgttgtgtgccggatccaacggggaatgaaactagagtaggacatgctcccaacccttttagaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaag

SEQ ID NO: 126844 - DNA, 2127 bp, Homo sapiens
  Payload ID: 4868
  Gene Symbol: DPYS
  Gene Name: dihydropyrimidinase
  Uniprot ID: Q14117
  ENST ID: ENST00000351513
  CDS Start-End: 134-1693
atttgcagcctgaggcagagctcgggggctgtcggtggggaccttgcaggagggcaccccaagcccgcccggcccgcccaacccagcccctgcgcgcagcccgggccgagtaggaccccgcgcgcccctcgctatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggctgctctctcaggaggcaccaccatgattattgatttcgccattcctcagaaaggtggctccctcattgaggccttcgagacctggcgaagctgggctgatcccaaagtttgctgcgactacagccttcatgtggcagtgacgtggtggagtgaccaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaagaagatgttggctctggggataacaggccctgagggccacgagctgtgccgcccagaggcagtggaggcagaggccacgctgagagccatcaccatagccagcgctgtgaactgtcctctctacattgtgcatgtgatgagcaagtctgcagctaaggtgatagcggatgcaaggagagatgggaaggtggtctatggtgaacccatagcagccagtcttggcacagatggcactcactactggaataaagaatggcaccatgcagcccaccatgtcatgggtccacctttgcgaccagacccctcaacacccgacttcctcatgaatctgttggctaatgatgatctaaccacaacagggactgataactgcactttcaacacctgccagaaagctcttgggaaggatgattttaccaagatccccaatggggtgaatggtgttgaagatcggatgtccgtaatatgggaaaaaggcgtgcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctgaagtgtgtgccatcggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagttttaaaatagctctgtgattttactttttattgtaattaataaacattgagatcttcattttatacctta

SEQ ID NO: 126845 - DNA, 576 bp, Homo sapiens
  Payload ID: 4868
  Gene Symbol: DPYS
  Gene Name: dihydropyrimidinase
  ENST ID: ENST00000521573
  CDS Start-End: 125-576
ctgaggcagagctcgggggctgtcggtggggaccttgcaggagggcaccccaagcccgcccggcccgcccaacccagcccctgcgcgcagcccgggccgagtaggaccccgcgcgcccctcgctatggcggcgccctcgcggctcctgatccgcgggggtcgcgtggtcaacgatgacttctcggaggtggccgacgtgctggtggaggacggcgtggtgcgggcactcgggcacgacctgctgcctcccgggggcgctcctgcggggctgcgggtcctcgacgccgccggcaagctcgtcctgcccggaggcatcgacacacacacgcacatgcagttccccttcatgggctcgcggtccatcgacgacttccaccagggcaccaaggttaaagaagaaatgaaaatccttgtgcaagataaaggtgttaactctttcaagatgtttatggcctataaagatctgtacatggtgacagacctggagctgtacgaagccttctctcggtgcaaggaaattggagcaattgcccaggtccatgcggaaaatggagacttaattgcagagggagcaaa

SEQ ID NO: 126846 - DNA, 426 bp, Homo sapiens
  Payload ID: 4868
  Gene Symbol: DPYS
  Gene Name: dihydropyrimidinase
  ENST ID: ENST00000533874
  CDS Start-End: 1-163
aggagatgggaagtttattcctcgaaaaccatttgctgaatatatttacaaacgaataaagcagcgagaccgggtaaaaaaatcagaggaaaggaggctgccattcccttcacagccaaacattgtcaacccatggagaagcaggccttattcaactccctaggatcctttagaaaaaattcaccactataggcttctttgattttctttcagaagcaattgctgtctttctcactgtgtttttgttgctgcataagattgaaggtataaatttatattattgtgatggaaaggctgtgtggaaattcattgatgatactttaaaatgtcatctttgcttgtactagatttcttacttagaatttttaaaaatcattttcttgtttaaatagtttctttttttaaaaaaatggttacattagtttt

SEQ ID NO: 126847 - DNA, 4603 bp, Homo sapiens
  Payload ID: 4869
  Gene Symbol: DPYSL2
  Gene Name: dihydropyrimidinase-like 2
  Uniprot ID: Q16555
  ENST ID: ENST00000311151
  CDS Start-End: 413-2131
aatcgctgctcgtctctctcgaagcggatggcttttgcctgagaggaaagggagtggctggcggcgcatgcgccacggtggccgacttgaaccgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaggg

SEQ ID NO: 126848 - DNA, 562 bp, Homo sapiens
  Payload ID: 4869
  Gene Symbol: DPYSL2
  Gene Name: dihydropyrimidinase-like 2
  ENST ID: ENST00000493789
  CDS Start-End: 52-562
acaaaaggatgtttcagggcggggtttcccataccccgcagccttccccggatgcctccttcccggctcggagttggaagggtttcctcagggctctcatttcctgcagcccggcgcctccacgcgggccagatcccgtctctgcagcctccccccggcccgcgcccattccccgcccccaggagccgggcccggacgctcccgggaagcagccgccctctccggggccgggcgtggccgggccctccccgccgggttcccgcccgccgccgttccagtcctcagccgcgccagggcgggggccagagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctg

SEQ ID NO: 126849 - DNA, 4552 bp, Homo sapiens
  Payload ID: 4869
  Gene Symbol: DPYSL2
  Gene Name: dihydropyrimidinase-like 2
  Uniprot ID: Q16555
  ENST ID: ENST00000521913
  CDS Start-End: 475-2085
actggcagacggacggacggacggcgaggaccctacccgagcccccgagccatggccgagagaaagcaatccgggaaggcggcagaggacgaagaggtccctgctttttttaaaaacctgggctccggcagccccaagccccggcagaaattctgtggcatgttctgcccggtggaagggtcctcggagaacaagaccatcgacttcgactcgctgtcggtgggccggggctcggggcaggtggtggctcagcagcgggacgtcgcccacttgggcccggacccgcagccgccgtactcgcggcagggccggcgcgccggcggagagccatctgttgaatcgggccggaaggtggagatccggagggcctcgggcaaagaagccctgcagaacatcaacgaccagagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgttt

SEQ ID NO: 126850 - DNA, 2130 bp, Homo sapiens
  Payload ID: 4869
  Gene Symbol: DPYSL2
  Gene Name: dihydropyrimidinase-like 2
  Uniprot ID: Q16555
  ENST ID: ENST00000523027
  CDS Start-End: 199-1809
cctttctgttgctaacggaggcgatggtgatggtggtggtggttgtgggagatgcagtgatccaggattagaagtcgcatcgtttgcaaggcattaaacaggagcgcgagtgcacgaaggtagccttagagcgatcgtcttctgatcaaaggaggtaaaattgttaatgatgaccagtcgttctatgcagacatatacatggaagatgggttgatcaagcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcattgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggggtaaattccttcctcgtgtacatggctttcaaagatcgcttccagctaacggattgccagatttatgaagtactgagtgtgatccgggatattggcgccatagcccaagtccacgcagaaaatggcgacatcattgcagaggagcagcagaggatcctggatctgggcatcacgggccccgagggacatgtgctgagccgacctgaggaggtcgaggccgaagccgtgaatcgtgccatcaccatcgccaaccagaccaactgcccgctgtatatcaccaaggtgatgagcaaaagctctgctgaggtcatcgcccaggcacggaagaagggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctgtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagctctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcaggctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttc

SEQ ID NO: 126851 - DNA, 5476 bp, Homo sapiens
  Payload ID: 4870
  Gene Symbol: DPYSL3
  Gene Name: dihydropyrimidinase-like 3
  Uniprot ID: Q14195
  ENST ID: ENST00000343218
  CDS Start-End: 199-2253
tgctccgcgcgctagctggctgtgtggctcgctggctcgctagggacaagcaggaatcggagcagcactgccgcctctggcgcgaaggctcaggcgcctcctcccgccacagtcactgtggctcggcgcacgctgccggcggctgccctttccgcctctggggaagaaaaacccgcgggccgctttcgtgcttgaaccatggcctcgggccggaggggctgggacagctcccacgaagacgatctgcccgtgtacctggccaggccgggcaccacggaccaggtcccgcggcagaaatacggcggcatgttctgcaacgtggagggcgccttcgagagcaagacgctggatttcgatgccctcagcgtggggcagcggggcgcgaagactcctcggagcggccagggcagcgaccgaggatcggggagtcggcccgggatcgagggggacaccccgcgcaggggccaaggccgggaagagagcagggagcccgcgcccgcctcccccgcccccgccggggtagagatccggagcgccaccggcaaagaggtgttgcagaacctcggccccaaggacaagagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaatta

SEQ ID NO: 126852 - DNA, 5309 bp, Homo sapiens
  Payload ID: 4870
  Gene Symbol: DPYSL3
  Gene Name: dihydropyrimidinase-like 3
  Uniprot ID: Q14195
  ENST ID: ENST00000398514
  CDS Start-End: 373-2085
ggcagatgcaaagaggaaaatcaatagggataagagagaagagggaggagtcgcagatcagccattcttgtcttatggggtcccagctggcgcagcaaaagaaaaaaaaaaacaaaacccgggcgtgaacgcgggtggaggagggtgtgcgtgggggggcgggggtgaaagggggaccggggagatttactattgtctctggcagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattac

SEQ ID NO: 126853 - DNA, 539 bp, Homo sapiens
  Payload ID: 4870
  Gene Symbol: DPYSL3
  Gene Name: dihydropyrimidinase-like 3
  ENST ID: ENST00000512722
  CDS Start-End: 263-539
gcggccgccgcattcgacccgcgccatggcagaggagagcgggtgccgggagggaagccgggaaccgtctccattctgaaactagggcggggaagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaaggga

SEQ ID NO: 126854 - DNA, 584 bp, Homo sapiens
  Payload ID: 4870
  Gene Symbol: DPYSL3
  Gene Name: dihydropyrimidinase-like 3
  ENST ID: ENST00000523458
  CDS Start-End: 1-228
gctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccaggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcct

SEQ ID NO: 126855 - DNA, 838 bp, Homo sapiens
  Payload ID: 4870
  Gene Symbol: DPYSL3
  Gene Name: dihydropyrimidinase-like 3
  ENST ID: ENST00000520473
  CDS Start-End: 1-628
gacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttg

SEQ ID NO: 126856 - DNA, 2729 bp, Homo sapiens
  Payload ID: 4871
  Gene Symbol: DPYSL4
  Gene Name: dihydropyrimidinase-like 4
  Uniprot ID: O14531
  ENST ID: ENST00000338492
  CDS Start-End: 165-1883
gcccagcgggggcgggaccggaacggagccgtgcggccccgcgcgctcgcagtctgtctcccgccgtccccacgcacgcgtcccggctcacgcgtccccccgcccgcccgcccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggagcagaagcggttgctggagctcggcatcactggccccgagggccacgtgctcagccaccccgaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacaggctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagccgcctgtgcatggaa

SEQ ID NO: 126857 - DNA, 1545 bp, Homo sapiens
  Payload ID: 4871
  Gene Symbol: DPYSL4
  Gene Name: dihydropyrimidinase-like 4
  ENST ID: ENST00000368627
  CDS Start-End: 2-1240
gatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgctggcggagatccacggtgtgccccgtggactgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggac

SEQ ID NO: 126858 - DNA, 5209 bp, Homo sapiens
  Payload ID: 4872
  Gene Symbol: DPYSL5
  Gene Name: dihydropyrimidinase-like 5
  Uniprot ID: Q9BPU6
  ENST ID: ENST00000288699
  CDS Start-End: 159-1853
ccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccaccacacacacacacacacacacacacacacacacacacgcacggcttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttctaaagccccacagaagttcccatggaaacactagaggccgggtgtctccttccacctccagtgatctgggaagtgacccagccgcctgcccttgttaagcctggtctgccccgtgggaagtgacttcatgttgcacatgtgatttcagcccccgaggcttgcgcgaggcttctggaccctcggttaaaggtcagcccctggccgggtgcggtggctcacgcctgtaatcccagcactttgggaggccaaggcgggtggatcatggagtcaggagatcgagaccatcctggctaacacggtgaaaccccgtctctactaaaaatacaaaaattacccaggcgtggtggcgggcgcctgtagtcccagctactgaggaggctgaggcaggagaatagcgtgaacccgggaggcggagcttgcagtgagccaagatcacgccactgcacttcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgccttagctgctctctaggtttgtggggttaagttgccagaaaattgtgctactgtgtgtgcgtgtgcgtgcgtgtgtgtagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctca

SEQ ID NO: 126859 - DNA, 1972 bp, Homo sapiens
  Payload ID: 4872
  Gene Symbol: DPYSL5
  Gene Name: dihydropyrimidinase-like 5
  Uniprot ID: Q9BPU6
  ENST ID: ENST00000401478
  CDS Start-End: 76-1770
ctcccgggctaggacatcctcctctcccccttctgtttctgcgtgaggcgcacaaaagggcggggagccgggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttc

SEQ ID NO: 126860 - DNA, 647 bp, Homo sapiens
  Payload ID: 4872
  Gene Symbol: DPYSL5
  Gene Name: dihydropyrimidinase-like 5
  ENST ID: ENST00000431402
  CDS Start-End: 79-647
atcggggctaagccggggcgctcttggggtcctctttgtacgcccgcgaagcgccgtgccgggccttgctcatagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgt

SEQ ID NO: 126861 - DNA, 621 bp, Homo sapiens
  Payload ID: 4872
  Gene Symbol: DPYSL5
  Gene Name: dihydropyrimidinase-like 5
  ENST ID: ENST00000450961
  CDS Start-End: 126-621
gtcctccggaaccgcccccggccctccctggggacccgtgcctcagcgcgtccaggctttgtggtgtcctgagtcgccatggaaacccgagggaacgcggagccgggtgctaggggggtcggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacc

SEQ ID NO: 126862 - DNA, 560 bp, Homo sapiens
  Payload ID: 4872
  Gene Symbol: DPYSL5
  Gene Name: dihydropyrimidinase-like 5
  ENST ID: ENST00000434719
  CDS Start-End: 37-560
aatgcgtgctcgcggggttgcaaagccctggggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgta

SEQ ID NO: 126863 - DNA, 5128 bp, Homo sapiens
  Payload ID: 4872
  Gene Symbol: DPYSL5
  Gene Name: dihydropyrimidinase-like 5
  Uniprot ID: Q9BPU6
  ENST ID: ENST00000614712
  CDS Start-End: 79-1773
atcggggctaagccggggcgctcttggggtcctctttgtacgcccgcgaagcgccgtgccgggccttgctcatagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccaccacacacacacacacacacacacacacacacacacacgcacggcttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttctaaagccccacagaagttcccatggaaacactagaggccgggtgtctccttccacctccagtgatctgggaagtgacccagccgcctgcccttgttaagcctggtctgccccgtgggaagtgacttcatgttgcacatgtgatttcagcccccgaggcttgcgcgaggcttctggaccctcggttaaaggtcagcccctggccgggtgcggtggctcacgcctgtaatcccagcactttgggaggccaaggcgggtggatcatggagtcaggagatcgagaccatcctggctaacacggtgaaaccccgtctctactaaaaatacaaaaattacccaggcgtggtggcgggcgcctgtagtcccagctactgaggaggctgaggcaggagaatagcgtgaacccgggaggcggagcttgcagtgagccaagatcacgccactgcacttcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgccttagctgctctctaggtttgtggggttaagttgccagaaaattgtgctactgtgtgtgcgtgtgcgtgcgtgtgtgtagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctc

SEQ ID NO: 126864 - DNA, 1779 bp, Homo sapiens
  Payload ID: 4873
  Gene Symbol: DPYD
  Gene Name: dihydropyrimidine dehydrogenase
  Uniprot ID: Q12882
  ENST ID: ENST00000306031
  CDS Start-End: 128-649
cgcgccgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgagactttgatcctggctttctctttaatgaatcatttgtaaagactttgattcttcagacactcttgggctctctgacgtctcctatttggagtcaacaagcaggttaattcccatgtatcatttaaatgatcagcttatatgaagggtatagtaagattttataatctttggagactagttggctagaaggtcaaattaagtgcccgtcaacctagatttttagttaatgacttactgatctggttttgtcagcataaacacaatgtgttctttcattttgggacccttcccataatattcctcaagcttaagtctcactttgctcttagtaataaatcagggttattcccttcctgctttctgacaggttaattctaaagaagagctcctgggaataagaaaataaaaacaattcgaggttgtggattgttgcaataaattctgggatttaatttcttttcttaccaaattcaaaattgcattaggcttacctgaccactacgaagtatgatctttactacctgtgaaaatccttagttgatggagaagattcacttgaattcctcctcacttttctttggggacccattgcctcttcattaaaccagggcaagctttcacagatgcagtaagtgaaaggtcacatagtatgtatatcaactaacacagcattttaaaacaaaatgaattaaaatgatatcattagtaattgatctggtcatgagaggtgtgtgtgtttgtgtgtgtgtgtgtgtgtgtgtgagagagagagagagaaagagagagagagacagggaaatacattattcctctggaaactctcacatggttttaattcttttctctgggaacactgtccctctgggaactcttacttggttctaccactcattcccagagcagagtctatttaagacagagacatgtgccttcagaacagaatttattagaaacttactaaaatttgagagtggtcacacttaggtcttgccataagtatcacctaatgaagagttatgcatagattaggactgcagtagatgcattttaagtgaatcaaggaatttagaataggaatgtatctgcttatttcattccaattatagtttgtataattgtaatttcaatatcaaattataaattaaaaatgtcctcgtgggaactactga

SEQ ID NO: 126865 - DNA, 4412 bp, Homo sapiens
  Payload ID: 4873
  Gene Symbol: DPYD
  Gene Name: dihydropyrimidine dehydrogenase
  Uniprot ID: Q12882
  ENST ID: ENST00000370192
  CDS Start-End: 102-3179
tttcgactcgcgctccggctgctgtcacttggctctctggctggagcttgaggacgcaaggagggtttgtcactggcagactcgagactgtaggcactgccatggcccctgtgctcagtaaggactcggcggacatcgagagtatcctggctttaaatcctcgaacacaaactcatgcaactctgtgttccacttcggccaagaaattagacaagaaacattggaaaagaaatcctgataagaactgctttaattgtgagaagctggagaataattttgatgacatcaagcacacgactcttggtgagcgaggagctctccgagaagcaatgagatgcctgaaatgtgcagatgccccgtgtcagaagagctgtccaactaatcttgatattaaatcattcatcacaagtattgcaaacaagaactattatggagctgctaagatgatattttctgacaacccacttggtctgacttgtggaatggtatgtccaacctctgatctttgtgtaggtggatgcaatttatatgccactgaagagggacccattaatattggtggattgcagcaatttgctactgaggtattcaaagcaatgagtatcccacagatcagaaatccttcgctgcctcccccagaaaaaatgtctgaagcctattctgcaaagattgctctttttggtgctgggcctgcaagtataagttgtgcttcctttttggctcgattggggtactctgacatcactatatttgaaaaacaagaatatgttggtggtttaagtacttctgaaattcctcagttccggctgccgtatgatgtagtgaattttgagattgagctaatgaaggaccttggtgtaaagataatttgcggtaaaagcctttcagtgaatgaaatgactcttagcactttgaaagaaaaaggctacaaagctgctttcattggaataggtttgccagaacccaataaagatgccatcttccaaggcctgacgcaggaccaggggttttatacatccaaagactttttgccacttgtagccaaaggcagtaaagcaggaatgtgcgcctgtcactctccattgccatcgatacggggagtcgtgattgtacttggagctggagacactgcctttgactgtgcaacatctgctctacgttgtggagctcgccgtgtgttcatcgtcttcagaaaaggctttgttaatataagagctgtccctgaggagatggaacttgctaaggaagaaaagtgtgaatttctgccattcctgtccccacggaaggttatagtaaaaggtgggagaattgttgctatgcagtttgttcggacagagcaagatgaaactggaaaatggaatgaagatgaagatcagatggtccatctgaaagccgatgtggtcatcagtgcctttggttcagttctgagtgatcctaaagtaaaagaagccttgagccctataaaatttaacagatggggtctcccagaagtagatccagaaactatgcaaactagtgaagcatgggtatttgcaggtggtgatgtcgttggtttggctaacactacagtggaatcggtgaatgatggaaagcaagcttcttggtacattcacaaatacgtacagtcacaatatggagcttccgtttctgccaagcctgaactacccctcttttacactcctattgatctggtggacattagtgtagaaatggccggattgaagtttataaatccttttggtcttgctagcgcaactccagccaccagcacatcaatgattcgaagagcttttgaagctggatggggttttgccctcaccaaaactttctctcttgataaggacattgtgacaaatgtttcccccagaatcatccggggaaccacctctggccccatgtatggccctggacaaagctcctttctgaatattgagctcatcagtgagaaaacggctgcatattggtgtcaaagtgtcactgaactaaaggctgactttccagacaacattgtgattgctagcattatgtgcagttacaataaaaatgactggacggaacttgccaagaagtctgaggattctggagcagatgccctggagttaaatttatcatgtccacatggcatgggagaaagaggaatgggcctggcctgtgggcaggatccagagctggtgcggaacatctgccgctgggttaggcaagctgttcagattcctttttttgccaagctgaccccaaatgtcactgatattgtgagcatcgcaagagctgcaaaggaaggtggtgccaatggcgttacagccaccaacactgtctcaggtctgatgggattaaaatctgatggcacaccttggccagcagtggggattgcaaagcgaactacatatggaggagtgtctgggacagcaatcagacctattgctttgagagctgtgacctccattgctcgtgctctgcctggatttcccattttggctactggtggaattgactctgctgaaagtggtcttcagtttctccatagtggtgcttccgtcctccaggtatgcagtgccattcagaatcaggatttcactgtgatcgaagactactgcactggcctcaaagccctgctttatctgaaaagcattgaagaactacaagactgggatggacagagtccagctactgtgagtcaccagaaagggaaaccagttccacgtatagctgaactcatggacaagaaactgccaagttttggaccttatctggaacagcgcaagaaaatcatagcagaaaacaagattagactgaaagaacaaaatgtagctttttcaccacttaagagaaactgttttatccccaaaaggcctattcctaccatcaaggatgtaataggaaaagcactgcagtaccttggaacatttggtgaattgagcaacgtagagcaagttgtggctatgattgatgaagaaatgtgtatcaactgtggtaaatgctacatgacctgtaatgattctggctaccaggctatacagtttgatccagaaacccacctgcccaccataaccgacacttgtacaggctgtactctgtgtctcagtgtttgccctattgtcgactgcatcaaaatggtttccaggacaacaccttatgaaccaaagagaggcgtacccttatctgtgaatccggtgtgttaaggtgatttgtgaaacagttgctgtgaactttcatgtcacctacatatgctgatcttttaaaatcatgatccttgtgttcagctctttccaaattaaaacaaatatacattttctaaataaaaatatgtaatttcaaaatacatttgtaagtgtaaaaaatgtctcatgtcaatgaccattcaattagtggtcataaaatagaataattcttttctgaggatagtagttaaataactgtgtggcagttaattggatgttcactgccagttgtcttatgtgaaaaattaacttttttgtggcaattagtgtgacagtttccaaattgccctatgctgtgctccatatttgatttctaattgtaagtgaaattaagcattttgaaacaaagtactctttaacatacaagaaaatgtatccaaggaaacattttatcattaaaaattacctttaattttaatgctgtttctaagaaaatgtagttagctccataaagtacaaatgaagaaagtcaaaaaattatttgctatggcaggataagaaagcctaaaattgagtttgtagaactttattaagtaaaatccccttcgctgaaattgcttatttttggtgttggatagaggatagggagaatatttactaactaaataccattcactactcatgcgtgagatgggtgtacaaactcatcctcttttaatggcatttctctttaaactatgttcctaacaaaatgagatgataggatagatcctggttaccactcttttgctgtgcacatacgggctctgactggttttaatagtcaccttcatgattatagcaactaatgtttgaacaaagctcaaagtatgcaatgcttcattattcaagaatgaaaaatataatgttgataatatatattaagtgtgccaaatcagtttgactactctctgttttagtgtttatgtttaaaagaaatatattttttgttattattagataatatttttgtatttctctattttcataatcagtaaatagtgtcatataaactcatttatctcctcttcatggcatcttcaatatgaatctataagtagtaaatcagaaagtaacaatctatggcttatttctatgacaaattcaagagctagaaaaataaaatgtttcattatgcacttttagaaatgcatatttgccacaaaacctgtattactgaataatatcaaataaaatatcataaagcattttaaa

SEQ ID NO: 126866 - DNA, 2068 bp, Homo sapiens
  Payload ID: 4874
  Gene Symbol: DUS1L
  Gene Name: dihydrouridine synthase 1-like
  Uniprot ID: Q6P1R4
  ENST ID: ENST00000306796
  CDS Start-End: 38-1459
cggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcgagagcccacagcctgtgaccactgccctctcagacccagggaggcatgagccggggcaggtgcggttggggccagtgggggcttctgaacaacaggatacatctaaatgaaggcagcatctgggtagacaaaagtgggggcttaggtcccctccccacctcccctaggcgcctccataggcaagtggccaaagcctccgggagcttcgtgatgcctcacagccttggaagcaccgcctgcgaggccacagtggctgctgctgggggctgttgaatctgagggccaggcttctcatttctctcaccaggccctgcctccaagcctagtcccagggagacagccctcaggaacccaaggccacccaggggtgac

SEQ ID NO: 126867 - DNA, 2151 bp, Homo sapiens
  Payload ID: 4874
  Gene Symbol: DUS1L
  Gene Name: dihydrouridine synthase 1-like
  Uniprot ID: Q6P1R4
  ENST ID: ENST00000354321
  CDS Start-End: 487-1908
ggaggagtctcgcgaggggcgcccctgtggcgtttcgggccagccgggccgcctggccgggtgcggagaaggaagctctgcccttcccctggcccggcgcggagccgattctcccgggaaggggccgggggtcctaacttcaccgccgggcggcctgctcagggccaggcccgcggggacgctggcgtcaaggtttcttcccccttcacgccagtcccctaccaggccgacatcgagtcccgctccccagggagggtcaagtcccaggggtccagcggctcccccgaggtccgctaggaggtggcggcactggagtggccgttctccagcctgcaccgacccccgcctttagtgcccccgcgtgtgacccaacggtggtactggagcggccttagaagggtgaccgctgcctctgagttgagtcttaagcccctcgttgggcctggctgaaccccgggtctgcgcctttcccccagcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcgagagcc

SEQ ID NO: 126868 - DNA, 1040 bp, Homo sapiens
  Payload ID: 4874
  Gene Symbol: DUS1L
  Gene Name: dihydrouridine synthase 1-like
  ENST ID: ENST00000542088
  CDS Start-End: 1-718
atccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaaggtgagtgggttccggctgcaagccaccaaggcttcagctttgggggtgggcagggtggtctctgcactgcttggggtggcaggtctggtgcccgcccagctgggtttgcaacgtggctcaaggtggcatggatgcctcaggacggccccttgcttccagccaagcccctgcccaggcctggaggggaagagagtctgggtgggtgggggtgagggagaggcatctggcttgggagcagttcccagggctgcatccaggccgtgggcatctggcagaggcttccccagtggggctgctcccctgctggccagcctggccccgggagtggtgctggccacaggctcccgagatttcctgtgcccagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgt

SEQ ID NO: 126869 - DNA, 1250 bp, Homo sapiens
  Payload ID: 4874
  Gene Symbol: DUS1L
  Gene Name: dihydrouridine synthase 1-like
  ENST ID: ENST00000538833
  CDS Start-End: 1-896
ttttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaaga

SEQ ID NO: 126870 - DNA, 725 bp, Homo sapiens
  Payload ID: 4874
  Gene Symbol: DUS1L
  Gene Name: dihydrouridine synthase 1-like
  ENST ID: ENST00000580731
  CDS Start-End: 1-575
ctaacgggaacatccagtgcctgcaggacgtggagcgctgcctccgggacacgggtgtgcagggcgtcatgagcgcaggtgggcagggcccaggacagcagccagggccccatgcacacggcctgataccaccgcccagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggcaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccag

SEQ ID NO: 126871 - DNA, 473 bp, Homo sapiens
  Payload ID: 4874
  Gene Symbol: DUS1L
  Gene Name: dihydrouridine synthase 1-like
  ENST ID: ENST00000577574
  CDS Start-End: 1-458
ggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 126872 - DNA, 937 bp, Homo sapiens
  Payload ID: 4874
  Gene Symbol: DUS1L
  Gene Name: dihydrouridine synthase 1-like
  ENST ID: ENST00000578176
  CDS Start-End: 196-937
gcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagagttttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccct

SEQ ID NO: 126873 - DNA, 1212 bp, Homo sapiens
  Payload ID: 4874
  Gene Symbol: DUS1L
  Gene Name: dihydrouridine synthase 1-like
  ENST ID: ENST00000582529
  CDS Start-End: 286-1212
ctcggagccgggcgcggtttccggggaacgcgtttcccgccgcaccgtgggccgcccggaccgcgcaggaccgggcaccttccggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaag

SEQ ID NO: 126874 - DNA, 648 bp, Homo sapiens
  Payload ID: 4874
  Gene Symbol: DUS1L
  Gene Name: dihydrouridine synthase 1-like
  ENST ID: ENST00000577907
  CDS Start-End: 193-648
cggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatg

SEQ ID NO: 126875 - DNA, 1084 bp, Homo sapiens
  Payload ID: 4874
  Gene Symbol: DUS1L
  Gene Name: dihydrouridine synthase 1-like
  ENST ID: ENST00000578907
  CDS Start-End: 182-1084
gcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcaggtgggcagggcccaggacagcagccagggccccatgcacacggcctgataccaccgcccagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacac

SEQ ID NO: 126876 - DNA, 1933 bp, Homo sapiens
  Payload ID: 4875
  Gene Symbol: DUS2
  Gene Name: dihydrouridine synthase 2
  Uniprot ID: Q9NX74
  ENST ID: ENST00000358896
  CDS Start-End: 118-1599
gcgacctcgcgtacggtggctggcgaggctcagtacggtgtgtggagctggagcaccgtgaggaagaagcgaggttctttttaagagttcagctgcgaggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaa

SEQ ID NO: 126877 - DNA, 1864 bp, Homo sapiens
  Payload ID: 4875
  Gene Symbol: DUS2
  Gene Name: dihydrouridine synthase 2
  ENST ID: ENST00000432752
  CDS Start-End: 159-1535
gtgtggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatgggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttc

SEQ ID NO: 126878 - DNA, 544 bp, Homo sapiens
  Payload ID: 4875
  Gene Symbol: DUS2
  Gene Name: dihydrouridine synthase 2
  ENST ID: ENST00000566306
  CDS Start-End: 199-544
agccacgcactggtgctaagcaatcaacagcaggagaggcagagattgggatggacaaagggatcatggaaggctccttcgagctggacttgaaggactgatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggct

SEQ ID NO: 126879 - DNA, 567 bp, Homo sapiens
  Payload ID: 4875
  Gene Symbol: DUS2
  Gene Name: dihydrouridine synthase 2
  ENST ID: ENST00000567100
  CDS Start-End: 324-567
agtacggtgtgtggagctggagcaccgtgaggaagaagcgaggttctttttaagagttcagctgcgagccaaggttcactctctactccctcgtcacgcgtcccaacttctcatccagaacccacccctcttgcagcccgctcagctccactggcttccccgtcagaaacctgaattacctaaaatagtagtaagaagggtgctgcgaccctacaaagtgatcaaatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcaga

SEQ ID NO: 126880 - DNA, 2310 bp, Homo sapiens
  Payload ID: 4875
  Gene Symbol: DUS2
  Gene Name: dihydrouridine synthase 2
  Uniprot ID: Q9NX74
  ENST ID: ENST00000565263
  CDS Start-End: 495-1976
tgaggcgcgccggctggttcaactccggccgccgcgccgaaaccagcagcggtccgggtcgaaccagcaccggcctcgggaggttccgccgcctgctctgccgctgttccaactgccgctgtagagccactgggatgcgcaccaccggcaggggttcgtcgggactgcggaccgtgaggccccgtcgcggcgccaggagcaaccgagtcacgagggaaaagagccgcaccggccgcgttagagccatgtttcccttagtgcgggagaagcgcacatcagtgacgtcacggacgcgccgcgacctcgcgtacggtggctggcgaggctcagtacggtgtgtggagctggagcaccgtgaggaagaagcgaggttctttttaagagttcagctgcgagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaa

SEQ ID NO: 126881 - DNA, 540 bp, Homo sapiens
  Payload ID: 4875
  Gene Symbol: DUS2
  Gene Name: dihydrouridine synthase 2
  ENST ID: ENST00000568099
  CDS Start-End: 220-540
acggtggctggcgaggctcagtacggtgtgtggagctggagcaccgtgaggaagaagcgaggttctttttaagagttcagctgcgaggtttcatccatttccatgtgccactgtttttcagatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtg

SEQ ID NO: 126882 - DNA, 373 bp, Homo sapiens
  Payload ID: 4875
  Gene Symbol: DUS2
  Gene Name: dihydrouridine synthase 2
  ENST ID: ENST00000569289
  CDS Start-End: 251-373
gaggttctttttaagagttcagctgcgagatatcaaacaaagaattactctgtacaaagccagaacacatatatcaaagtaatcctgaagtatcagaacaaaataatagattatttcctaatcagtatccagaattgggctcaacctcttctgttgctttcttatgtgaatcttgttcactcaagtgatggctccatgcaagttggccaaagggcttgtagtcctttactgggctgtaacagaggaggaaatgattttgaatagcctctctctgtgttaccataataagctaatcctggccccaatggttcgggtagggactcttccaatgaggctgctggccctggattatggagcggacattgtttactgt

SEQ ID NO: 126883 - DNA, 540 bp, Homo sapiens
  Payload ID: 4875
  Gene Symbol: DUS2
  Gene Name: dihydrouridine synthase 2
  ENST ID: ENST00000564781
  CDS Start-End: 386-540
ctttttaagagttcagctgcgaggtctgtagctccgaataggggatggcgacatccagacccggccagccttggggaagggcgcgtcgtggaggcaggactggaggctggcgatacgaggcggcagtggggccttgacccaatggaccatgagggcggagggcttctggcgattggttacctggttcctgggattctctttagttgttcctcattgccctgagatagcttgtcccgtgctggtatccgaggttgcagctgttttcccagatgtgttccctgcgcaggatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtg

SEQ ID NO: 126884 - DNA, 1712 bp, Homo sapiens
  Payload ID: 4875
  Gene Symbol: DUS2
  Gene Name: dihydrouridine synthase 2
  ENST ID: ENST00000561965
  CDS Start-End: 21-284
aggctgtaacagaggaggaaatgattttgaatagcctctctctgtgttaccataataagctaatcctggccccaatggttcgggtagggactcttccaatgaggctgctggccctggattatggagcggacattgtttactgtgagaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctccattcctgtcatagccaacggaggatctcatgaccacatccaacagtattcggacatagaggactttcgacaagccacggcagcctcttccgtgatggtggcccgagcagccatgtggaacccatctatcttcctcaaggagggtctgcggcccctggaggaggtcatgcagaaatacatcagatacgcggtgcagtatgacaaccactacaccaacaccaagtactgcttgtgccagatgctacgagaacagctggagtcgccccagggaaggttgctccatgctgcccagtcttcccgggaaatttgtgaggcctttggccttggtgccttctatgaggagaccacacaggagctggatgcccagcaggccaggctctcagccaagacttcagagcagacaggggagccagctgaagatacctctggtgtcattaagatggctgtcaagtttgaccggagagcatacccagcccagatcacccctaagatgtgcctactagagtggtgccggagggagaagttggcacagcctgtgtatgaaacggttcaacgccctctagatcgcctgttctcctctattgtcaccgttgctgaacaaaagtatcagtctaccttgtgggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttgcctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacct

SEQ ID NO: 126885 - DNA, 571 bp, Homo sapiens
  Payload ID: 4875
  Gene Symbol: DUS2
  Gene Name: dihydrouridine synthase 2
  ENST ID: ENST00000576994
  CDS Start-End: 351-571
gacttaaggggcaggcttcaggccttcagggttttgtggaggagagcagggcagagatagagaggaatcctgcctgggccctcccatccagccctccctacaaatgcctagtagccactctgtggggcacatctgtcggctggtacaagccccagtgaccacaggagggcaagagaaacctaaattctgatatgagctggagaggcaagattaatctaagagatagataggtagccacgcactggtgctaagcaatcaacagcaggagaggcagagattgggatggacaaagggatcatggaaggctccttcgagctggacttgaaggactggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtctt

SEQ ID NO: 126886 - DNA, 570 bp, Homo sapiens
  Payload ID: 4875
  Gene Symbol: DUS2
  Gene Name: dihydrouridine synthase 2
  ENST ID: ENST00000571081
  CDS Start-End: 307-570
gttttcttcctgtacctagaggtggcagtcggtgctcagcttccacagctctccttgatacacttgctcagacccctcggctactctcttgcccagcccagagtaccttttccacttgtctgaagacccgcagcaggtttccacgaaggacaccctgaagctcttcctcactccagccacgactcagcaactcctctatcaggaccggatatcaaacaaagaattactctgtacaaagccagaacacatatatcaaagtaatcctgaagtatcagaacaaaataataggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatg

SEQ ID NO: 126887 - DNA, 569 bp, Homo sapiens
  Payload ID: 4875
  Gene Symbol: DUS2
  Gene Name: dihydrouridine synthase 2
  ENST ID: ENST00000570709
  CDS Start-End: 201-569
agtcggtgctcagcttccacagctctccttgatacacttgctcagacccctcggctactctcttgcccagcccagagtaccttttccacttgtctgaagacccgcagcaggtttccacgaaggacaccctgaagctcttcctcactccagccacgactcagcaactcctctatcaggaccgggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaag

SEQ ID NO: 126888 - DNA, 570 bp, Homo sapiens
  Payload ID: 4875
  Gene Symbol: DUS2
  Gene Name: dihydrouridine synthase 2
  ENST ID: ENST00000575677
  CDS Start-End: 97-570
attttagggactgcacacttgatgttgcccagtgtctgctgtccaggaggaaggcagatcgatggccgagtgctcgaggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatc

SEQ ID NO: 126889 - DNA, 736 bp, Homo sapiens
  Payload ID: 4875
  Gene Symbol: DUS2
  Gene Name: dihydrouridine synthase 2
  ENST ID: ENST00000562246
  CDS Start-End: 112-736
gctggaaccttgaagaagggaagcctgctcttgataacaggagagattttcttcatttgaatttctgactcttgtttcctctttttttttcaggctgtaacagaggaggaaatgattttgaatagcctctctctgtgttaccataataagctaatcctggccccaatggttcgggtagggactcttccaatgaggctgctggccctggattatggagcggacattgtttactgtgaggagctgatcgacctcaagatgattcagtgcaagagagttgttaatgaggtgctcagcacagtggactttgtcgcccctgatgatcgagttgtcttccgcacctgtgaaagagagcagaacagggtggtcttccagatggggacttcagacgcagagcgagcccttgctgtggccaggcttgtagaaaatgatgtggctggtattgatgtcaacatgggctgtccaaaacaatattccaccaagggaggaatgggagctgccctgctgtcagaccctgacaagattgagaagatcctcagcactcttgttaaagggacacgcagacctgtgacctgcaagattcgcatcctgccatcgctagaagataccctgagccttgtgaagcggatagagaggactggcattgctgccatcgcagttcatgggaggaagcgggaggagcgacctcagcatcctgtcagctgtgaagtcatcaaagccattgctgataccctctcca

SEQ ID NO: 126890 - DNA, 2113 bp, Homo sapiens
  Payload ID: 4876
  Gene Symbol: DUS3L
  Gene Name: dihydrouridine synthase 3-like
  Uniprot ID: Q96G46
  ENST ID: ENST00000309061
  CDS Start-End: 98-2050
gacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 126891 - DNA, 1355 bp, Homo sapiens
  Payload ID: 4876
  Gene Symbol: DUS3L
  Gene Name: dihydrouridine synthase 3-like
  Uniprot ID: Q96G46
  ENST ID: ENST00000320699
  CDS Start-End: 66-1292
agggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgagctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 126892 - DNA, 977 bp, Homo sapiens
  Payload ID: 4876
  Gene Symbol: DUS3L
  Gene Name: dihydrouridine synthase 3-like
  ENST ID: ENST00000590110
  CDS Start-End: 85-738
gcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccag

SEQ ID NO: 126893 - DNA, 833 bp, Homo sapiens
  Payload ID: 4876
  Gene Symbol: DUS3L
  Gene Name: dihydrouridine synthase 3-like
  ENST ID: ENST00000590343
  CDS Start-End: 1-508
caaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattcttttaaaatccaggcctttctgtgaccctgaagcagcccctcctcggcccccaccttccccaaacctcttagctgcctccatgggccctgccccaagctgggtgctgctggtgcccagagaggccttgacccccaagaaggtagcgggttgaggacccggggggcctcagcctgtgtgggtgtggatcagggcagcctgcctggaggaggcggcctcaaagctgttaggggggtgttgctggaagaggcaaaggcctggcccagaatcctccctcccatggtgatgaccatgtctgccaacgtctgcccctgcttg

SEQ ID NO: 126894 - DNA, 806 bp, Homo sapiens
  Payload ID: 4876
  Gene Symbol: DUS3L
  Gene Name: dihydrouridine synthase 3-like
  ENST ID: ENST00000592491
  CDS Start-End: 1-234
accgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggcaatcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcgggtacgtgttgaggacaacgtcagtagcagatctgtccatctggtgtgcgtctattaaataccagctgtgtcca

SEQ ID NO: 126895 - DNA, 768 bp, Homo sapiens
  Payload ID: 4876
  Gene Symbol: DUS3L
  Gene Name: dihydrouridine synthase 3-like
  ENST ID: ENST00000591560
  CDS Start-End: 1-516
tgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgc

SEQ ID NO: 126896 - DNA, 797 bp, Homo sapiens
  Payload ID: 4876
  Gene Symbol: DUS3L
  Gene Name: dihydrouridine synthase 3-like
  ENST ID: ENST00000592468
  CDS Start-End: 1-419
ttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgc

SEQ ID NO: 126897 - DNA, 895 bp, Homo sapiens
  Payload ID: 4876
  Gene Symbol: DUS3L
  Gene Name: dihydrouridine synthase 3-like
  ENST ID: ENST00000585587
  CDS Start-End: 103-216
ggctgagggcgagaagccaccggctcttcattccgggccgttcttccgcctgcagggtggtcagcggaggtacctgagatcgtgcacgttggggcctgtcacatgcgcgaaggacaccacgtgcatgctagggcagatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggcaatcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctga

SEQ ID NO: 126898 - DNA, 2220 bp, Homo sapiens
  Payload ID: 4877
  Gene Symbol: DUS4L
  Gene Name: dihydrouridine synthase 4-like
  Uniprot ID: O95620
  ENST ID: ENST00000265720
  CDS Start-End: 363-1316
gaatcccggcgccgcccgcccacccagcccatggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgattgcccattgattgttcagtttgctgctaacgatgcaagacttttatctgatgctgctcgtatagtctgtccttatgcgaatggaatagacattaactgtggttgccctcagaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgttcataattaaagtattattttgttttgccaacatgaaaactgttataaggaaaca

SEQ ID NO: 126899 - DNA, 1676 bp, Homo sapiens
  Payload ID: 4877
  Gene Symbol: DUS4L
  Gene Name: dihydrouridine synthase 4-like
  ENST ID: ENST00000443233
  CDS Start-End: 371-730
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaaggtgggcaccggaacgtggccgcagcgcttatctgtgaatttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgattgcccattgattgttcagtttgctgctaacgatgcaagacttttatctgatgctgctcgtatagtctgtccttatgcgaatggaatagacattaactgtggttgccctcagaggtaaagctcaaagaagttggaagaattttccaaaagagtagaaaaaaaactgtgtgaacatggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattg

SEQ ID NO: 126900 - DNA, 1375 bp, Homo sapiens
  Payload ID: 4877
  Gene Symbol: DUS4L
  Gene Name: dihydrouridine synthase 4-like
  ENST ID: ENST00000431839
  CDS Start-End: 191-463
cccagcccatggctccaggcccacctggcgaactgactctcagcccgcgcctgggctaagcctggctaggagccgcgcagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaa

SEQ ID NO: 126901 - DNA, 857 bp, Homo sapiens
  Payload ID: 4877
  Gene Symbol: DUS4L
  Gene Name: dihydrouridine synthase 4-like
  ENST ID: ENST00000458611
  CDS Start-End: 296-442
cgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaaaagatggaaattctatcacattaaactgtgactccccattccactgttcctcacagcagcccctggcaaccattattctactttctccctctatgaacttcactactctaggttggcttttaggacactagtaagaaaatatagttgtgatctgtgttacacaccaatgattgttgccgctgattttgtcaaatctataaaagccagagacagcgaatttaccacaaatcaaggtgattgcccattgattgttcagtttgctgctaacgatgcaagacttttatctgatgctgctcgtatagtctgtccttatgcgaatggaatagacattaactgtggttgccctcagaggtgggcaatggcagaaggttatggggcttgcttaataaacaagccagagcttgttcaagacatggtgaaacaagtaagaaatcaagtggaaaccc

SEQ ID NO: 126902 - DNA, 1610 bp, Homo sapiens
  Payload ID: 4877
  Gene Symbol: DUS4L
  Gene Name: dihydrouridine synthase 4-like
  ENST ID: ENST00000422290
  CDS Start-End: 363-635
gaatcccggcgccgcccgcccacccagcccatggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaag

SEQ ID NO: 126903 - DNA, 2280 bp, Homo sapiens
  Payload ID: 4877
  Gene Symbol: DUS4L
  Gene Name: dihydrouridine synthase 4-like
  ENST ID: ENST00000436411
  CDS Start-End: 700-972
cccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaaggtgggcaccggaacgtggccgcagcgcttatctgtgaagcaagtattaaacctcagaacaggggccgcgcggcgtaaggcaggagagcagagcggaggtttcagggagcttcgtttgccctccacactcacaagagtcacgcgttagttgctacacagctttatctgttccacgccttgattggcactcctggggtaataaaagcccgcaggaaatgcttgggaagaaaagttgctggggatgaacagtgaagagaattagggagagtcgatgaagaaggaagtctgaaccataaaaggaccaataaaactcactgtctctaccctccttccttcccatgagacctttgaccttttgccttttctacttcttcctcagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttg

SEQ ID NO: 126904 - DNA, 2859 bp, Homo sapiens
  Payload ID: 4878
  Gene Symbol: DIMT1
  Gene Name: DIM1 dimethyladenosine transferase 1 homolog
  Uniprot ID: Q9UNQ2
  ENST ID: ENST00000199320
  CDS Start-End: 162-1103
gctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcaccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataggcttagcaaaatttcagagggttttgtaattgaaactggtttcaacttcagaaaaacagccatttcccataactacaggttcccagtattcctatgatttctggacaattaaaatttccagttcctttttcatatacctggtgcttagttttaagctattttaaaactgtcagactgagaatttcaatagatgtcataaactagttttattagctactatgtttaagtcaatataatactaagtgctgttaatatactataatagagttatagtagctattttgtttctataaaaaattaataaaaatatctttattgatatttggctttttttaatacctaacttaatagaagagtgtttccaattaatttaacaaagccagattttgaaatctggcttcaaagtcatagtaaatgttactacataattaaaataatgcttgttcttaatgtataatccagaacaaaggcatcaagctgcttttgttaaacaaatatgaaataatatacattaagagtagatttttttgtttaatttcacaaaactattttgcagagttcacttgtatcatctctatccttatagtaaaaattttaagatttaactcggctttctcaggttatttccctctacccctatgaactgctgagttttagttccttttctggccttcagttttcactatctgtaaagctgaaggactgtattatattacctccagtatcttttctggtactaatttttaaaatacctgatcagaatgaagccatcatagtgtaaggcagcatatttgtctataaggagactttccaaagacagtacccatccaatgcaaataataaatttgaagctaatcatctgttgtgctttaaaatgagcaaattcacatgtctttattgccctttgaaagttggttaatctcaaaaactaccttttttttaaatatcctttgcaaggtcaattgtaacagttctccatccttcctcttccctttgaaataaacacaaatagaatata

SEQ ID NO: 126905 - DNA, 1208 bp, Homo sapiens
  Payload ID: 4878
  Gene Symbol: DIMT1
  Gene Name: DIM1 dimethyladenosine transferase 1 homolog
  ENST ID: ENST00000506390
  CDS Start-End: 127-954
ctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcaccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattgtcagtgctgctgtgtatcctgtgaaacagatatgagcaactttgattactccaccctgtcctctaactactgacagttgtttttagccataacaagaatcagattcagcagttacaggttcctcaaagctgtagatatgtgtagcttgcacaacttaaaataattgtgtagtttactgtcctctgaattgtgaccacgtcttgtttcttgctcacatagcagttacaaatatagttattactttctttgtatagaaattgaaataaagttcatatggctcaatagcaga

SEQ ID NO: 126906 - DNA, 1034 bp, Homo sapiens
  Payload ID: 4878
  Gene Symbol: DIMT1
  Gene Name: DIM1 dimethyladenosine transferase 1 homolog
  ENST ID: ENST00000514911
  CDS Start-End: 168-632
ggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcaccttttgtcttcaagctgttgctacatcgaccttttttcaggtttgtgacaaaagactagagttactgccaaattttgaaagacttacagttcaggtggtgaacatagccaaaaatgagtcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtcca

SEQ ID NO: 126907 - DNA, 3920 bp, Homo sapiens
  Payload ID: 4879
  Gene Symbol: DDAH1
  Gene Name: dimethylarginine dimethylaminohydrolase 1
  Uniprot ID: O94760
  ENST ID: ENST00000284031
  CDS Start-End: 96-953
aggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaaatcttgctctgctcacttctatgtttgcagtcaaattattccttatgttggtgacctaaagagaattactttcattcatttcatttcccccgtagcagatggaaggagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtga

SEQ ID NO: 126908 - DNA, 4017 bp, Homo sapiens
  Payload ID: 4879
  Gene Symbol: DDAH1
  Gene Name: dimethylarginine dimethylaminohydrolase 1
  Uniprot ID: O94760
  ENST ID: ENST00000426972
  CDS Start-End: 503-1051
gtttgtttctggacttcaactggggaatcttgaggatgagtttgccccagaagagaaatttagagaaccttaccgtcagctgcccatttaaagcagggggtgtgttgtgggatgggggtgggaagctggagcaacagggccaggaggtgtgggagcgggagacactagagtaacctatgtgcacagcctctccatataccatgtgctgttgcgcctgctagtaatcgacgacattaggcaagagaaacagcggctcctcaagtcctgcccaaagaccgtccagaaaccccagcctcccgtcgccttctcgccgcctccgctgggagccgcagatcagtccaagttgacggacaggaggcgaaatgtgcaaatgtttatggtttcatctgtatggaaaaggagctctggtaactttggccaagacttttcagtaggaaatgcttcaaaatacaaagcaagagctattttcaagaaagaccttctaaatttatattaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaaatcttgctctgctcacttctatgtttgcagtcaaattattccttatgttggtgacctaaagagaattactttcattcatttcatttcccccgtagcagatggaaggagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtg

SEQ ID NO: 126909 - DNA, 1519 bp, Homo sapiens
  Payload ID: 4879
  Gene Symbol: DDAH1
  Gene Name: dimethylarginine dimethylaminohydrolase 1
  Uniprot ID: O94760
  ENST ID: ENST00000539042
  CDS Start-End: 100-957
caagaggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcatctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtg

SEQ ID NO: 126910 - DNA, 3909 bp, Homo sapiens
  Payload ID: 4879
  Gene Symbol: DDAH1
  Gene Name: dimethylarginine dimethylaminohydrolase 1
  Uniprot ID: O94760
  ENST ID: ENST00000535924
  CDS Start-End: 390-938
gggggtgggaagctggagcaacagggccaggaggtgtgggagcgggagacactagagtaacctatgtgcacagcctctccatataccatgtgctgttgcgcctgctagtaatcgacgacattaggcaagagaaacagcggctcctcaagtcctgcccaaagaccgtccagaaaccccagcctcccgtcgccttctcgccgcctccgctgggagccgcagatcagtccaagttgacggacaggaggcgaaatgtgcaaatgtttatggtttcatctgtatggaaaaggagctctggtaactttggccaagacttttcagtaggaaatgcttcaaaatacaaagcaagagctattttcaagaaagaccttctaaatttatattaggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctgagctgcagagtcccccccggtagccggcaagaccgcacaggcaaggccgatgactctgtgcccactcctgttgttttccttgacaatctactgtgccactgtgctactaactcttgtttacaaaatttgattctaagttgaattgcttcattcaacacccccaccctccctcccctcgaggtggtacctaagctgtggatttgctaaatgaattaagcaacctagaagatacagagctaatgaattatcaaaatgtgattaatcccagtaaggaaacactcatttagtgtctgtatttttggtgtgaaaattatttagttgccagtatattctgaagaatgtcttcttgatcagtcagataagcttgctttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtctcctctgcctctgactacatctgccaccaacaaccctcccctcacccctgccaggggcagacaggcttctcagcagaactgtgactgaaatcagagctgctgtctggggcagtgttaactacacagaggcacatcctgacagggtttgccccagagatctaaattccagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactcttttttttttttccttctactcatttctgtttccacctaccctgactcaccgtatttccagtcttctacccctgcagttatcctagtccagcaaagtcatttctttcaaaagagacatcatgtctgaaaataattactggtagtctaatatgagccagagtaaacagctcctcatggtcaatgaacatgttcaggaagcgatcaccttgatgcttgaacccaaccccagacagtggacaattctactttgaaatatccgtgaatatttactgtgggatccaatttaaacttctttcttctctagcctttaaattacacaactttgaactgacacggatctcttacaaagaacaatgcggcactgaaggaagagatgattcctttactcaaacctgcaggaatcagcctattaacaggcaggggaaacggtactttccaatgaatggtaactgatccaggcacattatcacacttcctagtcatctccacctttcctgtattgcctgtggcttgttgtttaagattaagaatcaaagagattaagaagtatcacttcaaatcttgctctgctcacttctatgtttgcagtcaaattattccttatgttggtgacctaaagagaattactttcattcatttcatttcccccgtagcagatggaaggagaaacctctgagaaaatgaaaacatccttaaccactatctttcccttttatttgattattttatgtcagaaatttgcaaaagtttttttctcctccttctcttccttgttgcttaactttttaattcatgccatatgcagatatccaattatgtgcatcctgtgaataaaccacgtcttggtcactgtcatattttgaaccatctcatcagagatgaataatatctttttaccagagagagaacgaatgttagccacatgcccaagttaacaaagaaaaaatgttctcaaggttgtccttttgggttaaatctggcccttccttggcaaaagcaaaaattctccctgtgagagctcaacatctcaaatacaaccacaggaaaaatggcccaatctgccagtttaggcttaccagcatataatttttaatatctttacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatagtattacttctttgatgttctcattagcataatgttatttttgaaaaggaaagatactatcacataagttttcctcatctgttgtgatatacaccaatggataaactaacggaaactgctttttgacattaaaagacaggagaaattatatttaactaagtaaaagttaagtcagaattacttgggtgatgtgattcaatttagttaaaggatgatatagagaaaatacattatttagcattatttcttcagctataatgaattgctatagaaatcaggcagatctttctaatgtgtattgattggtcttttcagctactctgaacagattactaaggccatctcctcatctctaagggagaaaaatagtctgtagatgaataatgtaaggtaaagagttgcatgtcagtctttgtaattatttacactttaactttctccagaactcagacatgatttcaacatggtgttagatttgtgcattttattttcctgaccacctcattccagccaatgtatggttatccactctgtgtgccaaaaccaatcatgcctttcacggccctttagttcagagaagttctgcactgatttttagtctcttgatgtctcaatcttacatgtataccaatcacaatggaataaagtgttgagttgtactgtgatcaa

SEQ ID NO: 126911 - DNA, 703 bp, Homo sapiens
  Payload ID: 4879
  Gene Symbol: DDAH1
  Gene Name: dimethylarginine dimethylaminohydrolase 1
  ENST ID: ENST00000633113
  CDS Start-End: 146-703
gttattatttgctccatggctcaatccgggtcagactgttcttcagtaacacaggtggatgttaaaacagggaatctgttgaaaagattgcggaggaactgcttcccaaaagcagttctggatggcaatttgatggcagtcagctatggttgacatgatgaaagaagcattagaaaaacttcagctcaatatagtagagatgaaagatgaaaatgcaactttagatggcggagatgttttattcacaggcagagaattttttgtgggcctttccaaaaggacaaatcaacgaggtgctgaaatcttggctgatacttttaaggactatgcagtctccacagtgccagtggcagatgggttgcatttgaagagtttctgcagcatggctgggcctaacctgatcgcaattgggtctagtgaatctgcacagaaggcccttaagatcatgcaacagatgagtgaccaccgctacgacaaactcactgtgcctgatgacatagcagcaaactgtatatatctaaatatccccaacaaagggcacgtcttgctgcaccgaaccccggaagagtatccagaaagtgcaaaggtttatgagaaactgaaggaccatatgctgatccccgtgagcatgtctgaactggaaaaggtggatgggctgctcacctgctgctcagttttaattaacaagaaagtagactcctga

SEQ ID NO: 126912 - DNA, 1330 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000375787
  CDS Start-End: 274-1131
cccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126913 - DNA, 1688 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000375789
  CDS Start-End: 632-1489
atactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcgcgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126914 - DNA, 1688 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000375792
  CDS Start-End: 632-1489
ataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126915 - DNA, 1330 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000383409
  CDS Start-End: 274-1131
cccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126916 - DNA, 1688 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000400062
  CDS Start-End: 632-1489
atactaggtcgtgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcccgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126917 - DNA, 1688 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000400063
  CDS Start-End: 632-1489
ataaaatacagaataaaaatcaagtgtttttacgcaatgggggtttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgcggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126918 - DNA, 882 bp, Homo sapiens
  Payload ID: 4880
  Gene Symbol: DDAH2
  Gene Name: dimethylarginine dimethylaminohydrolase 2
  ENST ID: ENST00000434279
  CDS Start-End: 205-882
ccgacagggacctcacaagcccccaagcaggggcaacaggtgttttggagattagagaccctagccttgttcctcaggctcctcttaaagaatctgacccctgagggtgctgggtagagtgaggtcgacaggagcggaagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctggg

SEQ ID NO: 126919 - DNA, 887 bp, Homo sapiens
  Payload ID: 4880
  Gene Symbol: DDAH2
  Gene Name: dimethylarginine dimethylaminohydrolase 2
  ENST ID: ENST00000439767
  CDS Start-End: 179-887
gtttatactaggtcgtgctaggggcagcgtgaccagccagggcggagagaggatgcttaactccttaggctcgaactcctcccttcctacccacctctctcccttctcgttcggacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcacc

SEQ ID NO: 126920 - DNA, 1688 bp, Homo sapiens; identical to SEQ ID NO: 126916
  Payload ID: 4880
  Gene Symbol: DDAH2
  Gene Name: dimethylarginine dimethylaminohydrolase 2
  Uniprot ID: O95865
  ENST ID: ENST00000443533
  CDS Start-End: 632-1489

SEQ ID NO: 126921 - DNA, 724 bp, Homo sapiens
  Payload ID: 4880
  Gene Symbol: DDAH2
  Gene Name: dimethylarginine dimethylaminohydrolase 2
  ENST ID: ENST00000436457
  CDS Start-End: 1-565
tcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccggatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126922 - DNA, 1330 bp, Homo sapiens; identical to SEQ ID NO: 126915
  Payload ID: 4880
  Gene Symbol: DDAH2
  Gene Name: dimethylarginine dimethylaminohydrolase 2
  Uniprot ID: O95865
  ENST ID: ENST00000424790
  CDS Start-End: 274-1131

SEQ ID NO: 126923 - DNA, 1688 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000434464
  CDS Start-End: 632-1489
ataaaatacagaataaaaatcaagtgtttttacgcaatgggggtttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126924 - DNA, 880 bp, Homo sapiens
  Payload ID: 4880
  Gene Symbol: DDAH2
  Gene Name: dimethylarginine dimethylaminohydrolase 2
  ENST ID: ENST00000444060
  CDS Start-End: 205-880
ccgacagggacctcacaagcccccaagcaggggcaacaggtgttttggagattagagaccctagccttgttcctcaggctcctcttaaagaatctgacccctgagggtgctgggtagagtgaggtcgacaggagcggaagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctg

SEQ ID NO: 126925 - DNA, 887 bp, Homo sapiens; identical to SEQ ID NO: 126919
  Payload ID: 4880
  Gene Symbol: DDAH2
  Gene Name: dimethylarginine dimethylaminohydrolase 2
  ENST ID: ENST00000455919
  CDS Start-End: 179-887

SEQ ID NO: 126926 - DNA, 1688 bp, Homo sapiens; identical to SEQ ID NO: 126913
  Payload ID: 4880
  Gene Symbol: DDAH2
  Gene Name: dimethylarginine dimethylaminohydrolase 2
  Uniprot ID: O95865
  ENST ID: ENST00000427126
  CDS Start-End: 632-1489

SEQ ID NO: 126927 - DNA, 882 bp, Homo sapiens; identical to SEQ ID NO: 126918
  Payload ID: 4880
  Gene Symbol: DDAH2
  Gene Name: dimethylarginine dimethylaminohydrolase 2
  ENST ID: ENST00000436437
  CDS Start-End: 205-882

SEQ ID NO: 126928 - DNA, 887 bp, Homo sapiens
  Payload ID: 4880
  Gene Symbol: DDAH2
  Gene Name: dimethylarginine dimethylaminohydrolase 2
  ENST ID: ENST00000416410
  CDS Start-End: 179-887
gtttatactaggtcgcgctaggggcagcgtgaccagccagggcggagagaggatgcttaactccttaggctcgaactcctcccttcctacccacctctctcccttctcgttcggacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcacc

SEQ ID NO: 126929 - DNA, 1688 bp, Homo sapiens
  Payload ID: 4880
  Gene Symbol: DDAH2
  Gene Name: dimethylarginine dimethylaminohydrolase 2
  Uniprot ID: O95865
  ENST ID: ENST00000437889
  CDS Start-End: 632-1489
ataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaga

SEQ ID NO: 126930 - DNA, 1688 bp, Homo sapiens; identical to SEQ ID NO: 126923
  Payload ID: 4880
  Gene Symbol: DDAH2
  Gene Name: dimethylarginine dimethylaminohydrolase 2
  Uniprot ID: O95865
  ENST ID: ENST00000454138
  CDS Start-End: 632-1489

SEQ ID NO: 126931 - DNA, 1330 bp, Homo sapiens; identical to SEQ ID NO: 126915
  Payload ID: 4880
  Gene Symbol: DDAH2
  Gene Name: dimethylarginine dimethylaminohydrolase 2
  Uniprot ID: O95865
  ENST ID: ENST00000413532
  CDS Start-End: 274-1131

SEQ ID NO: 126932 - DNA, 724 bp, Homo sapiens; identical to SEQ ID NO: 126921
  Payload ID: 4880
  Gene Symbol: DDAH2
  Gene Name: dimethylarginine dimethylaminohydrolase 2
  ENST ID: ENST00000444893
  CDS Start-End: 1-565

SEQ ID NO: 126933 - DNA, 1688 bp, Homo sapiens; identical to SEQ ID NO: 126913
  Payload ID: 4880
  Gene Symbol: DDAH2
  Gene Name: dimethylarginine dimethylaminohydrolase 2
  Uniprot ID: O95865
  ENST ID: ENST00000451411
  CDS Start-End: 632-1489

SEQ ID NO: 126934 - DNA, 1688 bp, Homo sapiens; identical to SEQ ID NO: 126913
  Payload ID: 4880
  Gene Symbol: DDAH2
  Gene Name: dimethylarginine dimethylaminohydrolase 2
  Uniprot ID: O95865
  ENST ID: ENST00000414455
  CDS Start-End: 632-1489

SEQ ID NO: 126935 - DNA, 1330 bp, Homo sapiens; identical to SEQ ID NO: 126915
  Payload ID: 4880
  Gene Symbol: DDAH2
  Gene Name: dimethylarginine dimethylaminohydrolase 2
  Uniprot ID: O95865
  ENST ID: ENST00000444699
  CDS Start-End: 274-1131

SEQ ID NO: 126936 - DNA, 887 bp, Homo sapiens; identical to SEQ ID NO: 126928
  Payload ID: 4880
  Gene Symbol: DDAH2
  Gene Name: dimethylarginine dimethylaminohydrolase 2
  ENST ID: ENST00000417916
  CDS Start-End: 179-887

SEQ ID NO: 126937 - DNA, 1688 bp, Homo sapiens; identical to SEQ ID NO: 126923
  Payload ID: 4880
  Gene Symbol: DDAH2
  Gene Name: dimethylarginine dimethylaminohydrolase 2
  Uniprot ID: O95865
  ENST ID: ENST00000447101
  CDS Start-End: 632-1489

SEQ ID NO: 126938 - DNA, 724 bp, Homo sapiens; identical to SEQ ID NO: 126921
  Payload ID: 4880
  Gene Symbol: DDAH2
  Gene Name: dimethylarginine dimethylaminohydrolase 2
  ENST ID: ENST00000450563
  CDS Start-End: 1-565

SEQ ID NO: 126939 - DNA, 1330 bp, Homo sapiens; identical to SEQ ID NO: 126915
  Payload ID: 4880
  Gene Symbol: DDAH2
  Gene Name: dimethylarginine dimethylaminohydrolase 2
  Uniprot ID: O95865
  ENST ID: ENST00000430482
  CDS Start-End: 274-1131

SEQ ID NO: 126940 - DNA, 887 bp, Homo sapiens; identical to SEQ ID NO: 126928
  Payload ID: 4880
  Gene Symbol: DDAH2
  Gene Name: dimethylarginine dimethylaminohydrolase 2
  ENST ID: ENST00000457271
  CDS Start-End: 179-887

SEQ ID NO: 126941 - DNA, 724 bp, Homo sapiens; identical to SEQ ID NO: 126921
  Payload ID: 4880
  Gene Symbol: DDAH2
  Gene Name: dimethylarginine dimethylaminohydrolase 2
  ENST ID: ENST00000413343
  CDS Start-End: 1-565

SEQ ID NO: 126942 - DNA, 1688 bp, Homo sapiens; identical to SEQ ID NO: 126917
  Payload ID: 4880
  Gene Symbol: DDAH2
  Gene Name: dimethylarginine dimethylaminohydrolase 2
  Uniprot ID: O95865
  ENST ID: ENST00000411456
  CDS Start-End: 632-1489

SEQ ID NO: 126943 - DNA, 882 bp, Homo sapiens; identical to SEQ ID NO: 126918
  Payload ID: 4880
  Gene Symbol: DDAH2
  Gene Name: dimethylarginine dimethylaminohydrolase 2
  ENST ID: ENST00000427351
  CDS Start-End: 205-882

SEQ ID NO: 126944 - DNA, 882 bp, Homo sapiens; identical to SEQ ID NO: 126918
  Payload ID: 4880
  Gene Symbol: DDAH2
  Gene Name: dimethylarginine dimethylaminohydrolase 2
  ENST ID: ENST00000434107
  CDS Start-End: 205-882

SEQ ID NO: 126945 - DNA, 887 bp, Homo sapiens; identical to SEQ ID NO: 126928
  Payload ID: 4880
  Gene Symbol: DDAH2
  Gene Name: dimethylarginine dimethylaminohydrolase 2
  ENST ID: ENST00000441011
  CDS Start-End: 179-887

SEQ ID NO: 126946 - DNA, 1330 bp, Homo sapiens; identical to SEQ ID NO: 126915
  Payload ID: 4880
  Gene Symbol: DDAH2
  Gene Name: dimethylarginine dimethylaminohydrolase 2
  Uniprot ID: O95865
  ENST ID: ENST00000426149
  CDS Start-End: 274-1131

SEQ ID NO: 126947 - DNA, 1688 bp, Homo sapiens; identical to SEQ ID NO: 126913
  Payload ID: 4880
  Gene Symbol: DDAH2
  Gene Name: dimethylarginine dimethylaminohydrolase 2
  Uniprot ID: O95865
  ENST ID: ENST00000413655
  CDS Start-End: 632-1489

SEQ ID NO: 126948 - DNA, 724 bp, Homo sapiens; identical to SEQ ID NO: 126921
  Payload ID: 4880
  Gene Symbol: DDAH2
  Gene Name: dimethylarginine dimethylaminohydrolase 2
  ENST ID: ENST00000437288
  CDS Start-End: 1-565

SEQ ID NO: 126949 - DNA, 724 bp, Homo sapiens; identical to SEQ ID NO: 126921
  Payload ID: 4880
  Gene Symbol: DDAH2
  Gene Name: dimethylarginine dimethylaminohydrolase 2
  ENST ID: ENST00000446426
  CDS Start-End: 1-565

SEQ ID NO: 126950 - DNA, 882 bp, Homo sapiens; identical to SEQ ID NO: 126918
  Payload ID: 4880
  Gene Symbol: DDAH2
  Gene Name: dimethylarginine dimethylaminohydrolase 2
  ENST ID: ENST00000437358
  CDS Start-End: 205-882

SEQ ID NO: 126951 - DNA, 887 bp, Homo sapiens; identical to SEQ ID NO: 126928
  Payload ID: 4880
  Gene Symbol: DDAH2
  Gene Name: dimethylarginine dimethylaminohydrolase 2
  ENST ID: ENST00000449216
  CDS Start-End: 179-887

SEQ ID NO: 126952 - DNA, 882 bp, Homo sapiens; identical to SEQ ID NO: 126918
  Payload ID: 4880
  Gene Symbol: DDAH2
  Gene Name: dimethylarginine dimethylaminohydrolase 2
  ENST ID: ENST00000417274
  CDS Start-End: 205-882

SEQ ID NO: 126953 - DNA, 724 bp, Homo sapiens; identical to SEQ ID NO: 126921
  Payload ID: 4880
  Gene Symbol: DDAH2
  Gene Name: dimethylarginine dimethylaminohydrolase 2
  ENST ID: ENST00000413287
  CDS Start-End: 1-565

SEQ ID NO: 126954 - DNA, 3106 bp, Homo sapiens
  Payload ID: 4881
  Gene Symbol: DMGDH
  Gene Name: dimethylglycine dehydrogenase
  Uniprot ID: Q9UI17
  ENST ID: ENST00000255189
  CDS Start-End: 30-2630
gcgcctgcgccctcggcctcggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagcaggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataagccagcagacttcataggaaagcaagcactgaaacagattaaagccaaggggctgaaacgaagactggtctgcctcaccttggcaacggatgatgttgatccagagggaaatgaaagcatctggtacaatggcaaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatga

SEQ ID NO: 126955 - DNA, 1966 bp, Homo sapiens
  Payload ID: 4881
  Gene Symbol: DMGDH
  Gene Name: dimethylglycine dehydrogenase
  ENST ID: ENST00000518477
  CDS Start-End: 10-306
ggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggccct

SEQ ID NO: 126956 - DNA, 572 bp, Homo sapiens
  Payload ID: 4881
  Gene Symbol: DMGDH
  Gene Name: dimethylglycine dehydrogenase
  ENST ID: ENST00000524206
  CDS Start-End: 7-159
ctagtcatgctccgtcccggcgcgcagctgctgcggggcctcctgctgcggagctgcccgctgcagggctcccccgggcgcccgcgctctgtctgcggccgggaagggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcag

SEQ ID NO: 126957 - DNA, 1517 bp, Homo sapiens
  Payload ID: 4881
  Gene Symbol: DMGDH
  Gene Name: dimethylglycine dehydrogenase
  ENST ID: ENST00000517853
  CDS Start-End: 10-330
ggcctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcaatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggccc

SEQ ID NO: 126958 - DNA, 554 bp, Homo sapiens
  Payload ID: 4881
  Gene Symbol: DMGDH
  Gene Name: dimethylglycine dehydrogenase
  ENST ID: ENST00000521052
  CDS Start-End: 55-207
aggctgcccgctggcctcggagcaggcgcctgcgccctcggcctcggcctagtcatgctccgtcccggcgcgcagctgctgcggggcctcctgctgcggagctgcccgctgcagggctcccccgggcgcccgcgctctgtctgcggccgggaagggtttaacaacttactttcatcctggaataaacttgaagaaaatacattatgatagcatcaaactttatgagaaactggaagaagaaactggtcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaa

SEQ ID NO: 126959 - DNA, 2777 bp, Homo sapiens
  Payload ID: 4881
  Gene Symbol: DMGDH
  Gene Name: dimethylglycine dehydrogenase
  ENST ID: ENST00000523732
  CDS Start-End: 1-1842
tatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataaggatcagaatagctgctttgcccattttaaggaggaaaatggctgggtgagcagatgggccatcaggccttattagggtgaatcgtgttcttgtcaaaacctgtcagcaagtagggaaaagaacaatggagtactgaagaactctttcatcacaaagggagacggcgcagtggcccttgcttccttccgtcttggagttgttccagcctccttcccctgctgttggcttatgtgaagttgatacacatgtatcattcattcatccgttcatctagtagacatttattaagtaccgctgattagacaccttgctaacccatagatctaaatgttaaagatatactcctgatggctctcagatctcatgaacctggaaacaaataatatttcaggaactaaagctgtagggatacgttcttagccgtaattgtgaagataacccttccgcaagtggagggctctccagccgcatacaacactgccatcttgtgggaagtgctccgtagagccacttcaggaagccttgaccaaagctgcggtaaaaataattgaatctgtacttttaaaatcttcttaactaaaaacgcttcacctgaaacgactcatatcattgttctcaatggtatttttggtatgttccaaaggaagtaacttttgggaggaaaatcagtagcctttgtttagttggagatggaagaaatgcattaatcaagagcaaaaggaaaatcagctgcctttggatggagtcataggcattcctggaattttcatggtggaaatattgaatttttgtccatttctggagaacctccacgaagattcacagagactcaagtattaaacgtaatgtgttgaagcacatcagaagaatttgttttctataatatgtttctccctctttttctcactctctccttctccctctctttccctttttctctctccttcccctctctccccgtgtagagcttctaactagtagaaacagaataaaatgtaatctctattaaa

SEQ ID NO: 126960 - DNA, 1592 bp, Homo sapiens
  Payload ID: 4882
  Gene Symbol: DPEP1
  Gene Name: dipeptidase 1 (renal)
  Uniprot ID: P16444
  ENST ID: ENST00000261615
  CDS Start-End: 123-1358
gtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacatcctggggtacgtgtcatcggca

SEQ ID NO: 126961 - DNA, 1734 bp, Homo sapiens
  Payload ID: 4882
  Gene Symbol: DPEP1
  Gene Name: dipeptidase 1 (renal)
  Uniprot ID: P16444
  ENST ID: ENST00000393092
  CDS Start-End: 292-1527
ggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacacccctt

SEQ ID NO: 126962 - DNA, 1647 bp, Homo sapiens
  Payload ID: 4882
  Gene Symbol: DPEP1
  Gene Name: dipeptidase 1 (renal)
  Uniprot ID: P16444
  ENST ID: ENST00000421184
  CDS Start-End: 204-1439
ggcacatccacacatgagggaaaaacactgccaggacatctcagggcactctcaggaaatgaggaagctgctggagaagtttctagccttgggggaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttc

SEQ ID NO: 126963 - DNA, 482 bp, Homo sapiens
  Payload ID: 4882
  Gene Symbol: DPEP1
  Gene Name: dipeptidase 1 (renal)
  ENST ID: ENST00000568281
  CDS Start-End: 149-482
aggaagcggccgggaagcaggcagagagcggccaggaagcgggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgt

SEQ ID NO: 126964 - DNA, 525 bp, Homo sapiens
  Payload ID: 4882
  Gene Symbol: DPEP1
  Gene Name: dipeptidase 1 (renal)
  ENST ID: ENST00000570029
  CDS Start-End: 204-525
ggcacatccacacatgagggaaaaacactgccaggacatctcagggcactctcaggaaatgaggaagctgctggagaagtttctagccttgggggaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgca

SEQ ID NO: 126965 - DNA, 1697 bp, Homo sapiens
  Payload ID: 4883
  Gene Symbol: DPEP2
  Gene Name: dipeptidase 2
  Uniprot ID: Q9H4A9
  ENST ID: ENST00000393847
  CDS Start-End: 125-1585
cggaattggtgggttcttggtctcactgagttctagaatgaagctgcagaccctcgcagtgagtgttacagctcttaaggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatagaaa

SEQ ID NO: 126966 - DNA, 2112 bp, Homo sapiens
  Payload ID: 4883
  Gene Symbol: DPEP2
  Gene Name: dipeptidase 2
  Uniprot ID: Q9H4A9
  ENST ID: ENST00000572888
  CDS Start-End: 652-2112
gagagagaaggtcagggccagggggccccttcctgaatccagtccacagggttaacccctcatttccagagcctatcttctcccccacacccacccacacaacccagcaccaggaaatccagagcccagagcactgtggtcacagggacacatgtggccctgggtgtggccgggacacgttgcaggcggttggggacatgacgtggtctgcagatctcccagggcagggcagagggccactgtttgggggaagcaccccaggccctctctcttagagagagagcctaggggcagcagaggagccacctgggtcggccccctggggacagtgggaggagtaaaagggagggtggagggccctaagacaggccgcgagtgggcgcccaggacagggatccgcccagccggcgggagcgcccttggggatgacggcgggagggctgggcgccccctggtggccgtactgggcggtgccgccgctctccgcacatccttcgcggggccctgtgacttcgttaccctcctcttgaggccacgccgccaggtggcctgaatcgagggtcgggactccatcgtcgcgctctgcccctcgcccgcccctctcaggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctga

SEQ ID NO: 126967 - DNA, 2248 bp, Homo sapiens
  Payload ID: 4883
  Gene Symbol: DPEP2
  Gene Name: dipeptidase 2
  ENST ID: ENST00000575203
  CDS Start-End: 667-1443
agactattgtttcttgggaattgtctgtatcagacatcatgggagcagatccagggcgacatcaaagggaagcatgagtctccaggaccagaggggcttggatgcagatgatcatcatctgggcactgctggatactgaagttctcattatgttgcctagactggtctcaaacctccggcttcaagagatcctctcacctcgaccttcaaattactgggattacaggcatgagccaccatgtcctaccagactttgttaaaagaggaacaggccaggcatcgtgggctcacatgaacactcatgccccagaagtaaacaagtgttagccaaccaggaggcctatcctccccctaacctcacccaaagccatctctgtgccctcccccttgcaggggaaacagcacacactagtgaaatcttgtcttagtgtgtccggaattggtgggttcttggtctcactgagttctagaatgaagctgcagaccctcgcagtgagtgttacagctcttaaggtagcgcgtctggagtttgtttcttttgatgtttggatgtttggagtttcttccttctggtgggtttgtggtcttgttggctcaggagtgaagctgcagaccttcgtggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaaccctggactgtggttctgagtcatgatcagggaatcaggtctgaaacccactagctggtggccacacagattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatag

SEQ ID NO: 126968 - DNA, 579 bp, Homo sapiens
  Payload ID: 4883
  Gene Symbol: DPEP2
  Gene Name: dipeptidase 2
  ENST ID: ENST00000572624
  CDS Start-End: 169-579
atctctgtgccctcccccttgcaggggaaacagcacacactagtgaaatcttgtcttagtgtgtccggaattggtgggttcttggtctcactgagttctagaatgaagctgcagaccctcgcagctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacggccagaccagcctggacaggcttagagatggcctcgtgggcgcccagttctggtcagcctatgtgcca

SEQ ID NO: 126969 - DNA, 559 bp, Homo sapiens
  Payload ID: 4883
  Gene Symbol: DPEP2
  Gene Name: dipeptidase 2
  ENST ID: ENST00000574865
  CDS Start-End: 217-559
ctgtgagagctcaagccacaggagccacaagataagaggagtgtggctgcagaacccaggtggcagggctttcctcaggccccttactcctgacctggacgaggccggggcttcctcaaggaggtaggaggtatcctggccagcagatcagccagaagctctaggaggaaggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctacg

SEQ ID NO: 126970 - DNA, 447 bp, Homo sapiens
  Payload ID: 4883
  Gene Symbol: DPEP2
  Gene Name: dipeptidase 2
  ENST ID: ENST00000575510
  CDS Start-End: 80-447
gtctgtatcagacatcatgggagcagatccagggcgacatcaaagggaagcatgagtctccaggaccagaggggcttggatgcagatgatcatcatctgggcactgctggatactgaggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggc

SEQ ID NO: 126971 - DNA, 580 bp, Homo sapiens
  Payload ID: 4883
  Gene Symbol: DPEP2
  Gene Name: dipeptidase 2
  ENST ID: ENST00000573808
  CDS Start-End: 97-580
gtgccctcccccttgcaggggaaacagcacacactagtgaaatcttgtcttagtgtgtccggaattggtgggttcttggtctcactgagttctagaatgaagctgcagaccctcgcagtgagtgttacagctcttaagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagaaggtggtggcagaaatgaaccgcctgggcatgatggtagacttatcccatgtctcagatgctgtggcacggcgggccctggaagtgtcacaggcacctg

SEQ ID NO: 126972 - DNA, 2018 bp, Homo sapiens
  Payload ID: 4884
  Gene Symbol: DPEP3
  Gene Name: dipeptidase 3
  Uniprot ID: Q9H4B8
  ENST ID: ENST00000268793
  CDS Start-End: 375-1916
gggaatctttctgtccatcaaaccagacagaccgaattaactcttctgagtcgcagcttagaatatttgacctgcctaggagctgggcacaagccggcagctaaccgccacgtgggcctgggtaggaggtgagatcaggaagatccctgggcccctactagttccctgcctggcctcctcccccactcgtgtgggggtctacggagccagcgctgggggtggaagggcgaggagtcctcgacgctgcagcggcggttccggcccatgggggcgctctcctgcttgggggcggaaaagccgtggcgcccccttgcgtggcgcgtcggtctcagagtcgcgtgacttcaaccccctcttcgggaggctgggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgctgcggcagcccgtaacccgcgcggagaccacgccgggcgcccccagagccctctccacgctgggctcccccagcctcttcaccacgccgggtgtccccagcgccctcactaccccaggcctcactacgccaggcacccccaaaaccctggaccttcggggtcgcgcgcaggccctgatgcggagtttcccactcgtggacggccacaatgacctgccccaggtcctgagacagcgttacaagaatgtgcttcaggatgttaacctgcgaaatttcagccatggtcagaccagcctggacaggcttagagacggcctcgtgggtgcccagttctggtcagcctccgtctcatgccagtcccaggaccagactgccgtgcgcctcgccctggagcagattgacctcattcaccgcatgtgtgcctcctactctgaactcgagcttgtgacctcagctgaaggtctgaacagctctcaaaagctggcctgcctcattggcgtggagggtggtcactcactggacagcagcctctctgtgctgcgcagtttctatgtgctgggggtgcgctacctgacacttaccttcacctgcagtacaccatgggcagagagttccaccaagttcagacaccacatgtacaccaacgtcagcggattgacaagctttggtgagaaagtagtagaggagttgaaccgcctgggcatgatgatagatttgtcctatgcatcggacaccttgataagaagggtcctggaagtgtctcaggctcctgtgatcttctcccactcagctgccagagctgtgtgtgacaatttgttgaatgttcccgatgatatcctgcagcttctgaagaagaacggtggcatcgtgatggtgacactgtccatgggggtgctgcagtgcaacctgcttgctaacgtgtccactgtggcagatcactttgaccacatcagggcagtcattggatctgagttcatcgggattggtggaaattatgacgggactggccggttccctcaggggctggaggatgtgtccacatacccagtcctgatagaggagttgctgagtcgtagctggagcgaggaagagcttcaaggtgtccttcgtggaaacctgctgcgggtcttcagacaagtggaaaaggtgagagaggagagcagggcgcagagccccgtggaggctgagtttccatatgggcaactgagcacatcctgccactcccacctcgtgcctcagaatggacaccaggctactcatctggaggtgaccaagcagccaaccaatcgggtcccctggaggtcctcaaatgcctccccataccttgttccaggccttgtggctgctgccaccatcccaaccttcacccagtggctctgctgacacagtcggtccccgcagaggtcactgtggcaaagcctcacaaagccccctctcctagttcattcacaagcatatgctgagaataaacatgttacacatgga

SEQ ID NO: 126973 - DNA, 3052 bp, Homo sapiens
  Payload ID: 4885
  Gene Symbol: DPP10
  Gene Name: dipeptidyl-peptidase 10 (non-functional)
  Uniprot ID: Q8N608
  ENST ID: ENST00000310323
  CDS Start-End: 128-2497
ggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggac

SEQ ID NO: 126974 - DNA, 862 bp, Homo sapiens
  Payload ID: 4885
  Gene Symbol: DPP10
  Gene Name: dipeptidyl-peptidase 10 (non-functional)
  ENST ID: ENST00000393146
  CDS Start-End: 87-862
gagtgacatgcaaggaactgacattgaagtaagattctgtgagggtgaggttgcatttgtagaaagtggttatagtccacttagcaatggtcatcacagaggtggctgagggaccagtagatggttctgaaaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccac

SEQ ID NO: 126975 - DNA, 2758 bp, Homo sapiens
  Payload ID: 4885
  Gene Symbol: DPP10
  Gene Name: dipeptidyl-peptidase 10 (non-functional)
  Uniprot ID: Q8N608
  ENST ID: ENST00000393147
  CDS Start-End: 356-2758
aagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataa

SEQ ID NO: 126976 - DNA, 6278 bp, Homo sapiens
  Payload ID: 4885
  Gene Symbol: DPP10
  Gene Name: dipeptidyl-peptidase 10 (non-functional)
  Uniprot ID: Q8N608
  ENST ID: ENST00000410059
  CDS Start-End: 481-2871
aaatattttgcactggaaaaactataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaaagaaaaaaatcaatatattgaattctttaattaaataggtaagcagtattaaatcatccacagagataaacaatctcttgaaactcttttgaaagagaaaagtgtttgttcactttcattgccttcattaagatctccaaatactcagagactaagcaggctattctcatctctttgagtttcctgacagaactaaaggaaggaatcactcttcaaaagatggatctcacttcactctgaaaatgtgcctttttttaattgggtgtttagcataaaaatcactattggggatcttacagatgtctgttgtagatctattacaatgaggtgacttagacattgggctttaccatattagagaattacttaagccattgtccttcaaatgttgggcttggagacagaagtaccttggactgaattgctttcaagtctctagaatcactgacagcacatagcttctatgaggagttatatatgaaataccacttgtgtccctcctcaagttctctgaccaccttcacatcctgcggccaccaacactgtatggatacaatctggcctctcagctctgctcactttcactttctgttctggggattctctgatactaattttggctacttggtagaaccaagagacaaatcgcttacatgctgcaaaccgatgtgaaggtgttactaacccgctaaaacacaattaatgaaagactgtagcaggtaactgatctttccctcagatattctacatggtccatggaagactctgtgggccgcagaagcccatagctgcatacccttctattttcctcttccccatttcactcttttaagctccctactcctattccctatgatcactttccaaaataaacggcaggtgtgctagctgttgtcttagactctgctttctggaaactatttttcccctccacaagaaattatcactgtgaatattacaggaggagaaataaaataagaataaatcagtggtttattttca

SEQ ID NO: 126977 - DNA, 3883 bp, Homo sapiens
  Payload ID: 4885
  Gene Symbol: DPP10
  Gene Name: dipeptidyl-peptidase 10 (non-functional)
  Uniprot ID: Q8N608
  ENST ID: ENST00000409163
  CDS Start-End: 661-2901
aagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtatacatacatgaagagtggcttcaggactggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacagatttttcattattcgtatactgcttcatatgtgatttacaacatacacactagggaagtttgggagttaaatcctccagaagtagaggactccgtcttgcagtacgcggcctggggtgtccaagggcagcagctgatttatatttttgaaaataatatctactatcaacctgatataaagagcagttcattgcgactgacatcttctggaaaagaagaaataatttttaatgggattgctgactggttatatgaagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggcaggtcaagtgaacccaacaataaaattatatgttgtaaacctgtatggaccaactcacactttggagctcatgccacctgacagctttaaatcaagagaatactatatcactatggttaaatgggtaagcaataccaagactgtggtaagatggttaaaccgagctcagaacatctccatcctcacagtctgtgagaccactacaggtgcttgtagtaaaaaatatgagatgacatcagatacgtggctctctcagcagaatgaggagcccgtgttttctagagacggcagcaaattctttatgacagtgcctgttaagcaagggggacgtggagaatttcaccacgtagctatgttcctcatccagagtaaaagtgagcaaattaccgtgcggcatctgacatcaggaaactgggaagtgataaagatcttggcatacgatgaaactactcaaaaaatttactttctgagcactgaatcttctcccagaggaaggcagctgtacagtgcttctactgaaggattattgaatcgccaatgcatttcatgtaatttcatgaaagaacaatgtacatattttgatgccagttttagtcccatgaatcaacatttcttattattctgtgaaggtccaagggtcccagtggtcagcctacatagtacggacaacccagcaaaatattttatattggaaagcaattctatgctgaaggaagctatcctgaagaagaagataggaaagccagaaattaaaatccttcatattgacgactatgaacttcctttacagttgtcccttcccaaagattttatggaccgaaaccagtatgctcttctgttaataatggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaagggttatggtggctatattgcatcaatgatcttaaaatcagatgaaaagctttttaaatgtggatccgtggttgcacctatcacagacttgaaattgtatgcctcagctttctctgaaagataccttgggatgccatctaaggaagaaagcacttaccaggcagccagtgtgctacataatgttcatggcttgaaagaagaaaatatattaataattcatggaactgctgacacaaaagttcatttccaacactcagcagaattaatcaagcacctaataaaagctggagtgaattatactatgcaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaa

SEQ ID NO: 126978 - DNA, 883 bp, Homo sapiens
  Payload ID: 4885
  Gene Symbol: DPP10
  Gene Name: dipeptidyl-peptidase 10 (non-functional)
  ENST ID: ENST00000436732
  CDS Start-End: 703-883
aaatattttgcactggaaaaactataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaagaattctgaaaactaactaagatgctggagaaattgggagaccatttgttgaagaaatacctactgaatcttggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaa

SEQ ID NO: 126979 - DNA, 565 bp, Homo sapiens
  Payload ID: 4885
  Gene Symbol: DPP10
  Gene Name: dipeptidyl-peptidase 10 (non-functional)
  ENST ID: ENST00000419287
  CDS Start-End: 275-565
gtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggaactgggaagtaacagccctccacagagaaactggaagggaattgctattgctctgctggtgattttagttgtatgctcactcatcactatgtcagtcatcctcttaaccccagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacag

SEQ ID NO: 126980 - DNA, 553 bp, Homo sapiens
  Payload ID: 4885
  Gene Symbol: DPP10
  Gene Name: dipeptidyl-peptidase 10 (non-functional)
  ENST ID: ENST00000429914
  CDS Start-End: 1-183
atgcgcaaggtggagagccgcggggaagggggcagagagatgaactcacaaattcgtcagaaaccagattgtctttggaagacctctttaggaaagactttgtgcttcacgatccagaggctcggtggatcaatgatacagatgtggtgtataaaagcgagaatggacatgtcattaaactgaatatagaaacaaatgctaccacattattattggaaaacacaacttttgtaaccttcaaagcatcaagacattcagtttcaccagatttaaaatatgtccttctggcatatgatgtcaaacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacaatttttcattattcgtatactgcttcatatgtgatttacaacatacacactagggaagtttgggagttaaatcctccagaagtagaggactccgt

SEQ ID NO: 126981 - DNA, 547 bp, Homo sapiens
  Payload ID: 4886
  Gene Symbol: DPP3
  Gene Name: dipeptidyl-peptidase 3
  ENST ID: ENST00000526515
  CDS Start-End: 37-547
gagtttgcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctct

SEQ ID NO: 126982 - DNA, 733 bp, Homo sapiens
  Payload ID: 4886
  Gene Symbol: DPP3
  Gene Name: dipeptidyl-peptidase 3
  ENST ID: ENST00000531354
  CDS Start-End: 131-733
tacaatagtattcccttccacatgggcttttgggaggattaaatgagatcataagagttcagagccaggtatgcaattggtatggggtaaacaacagctgtgatgacagtgatggttctcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttc

SEQ ID NO: 126983 - DNA, 2974 bp, Homo sapiens
  Payload ID: 4886
  Gene Symbol: DPP3
  Gene Name: dipeptidyl-peptidase 3
  ENST ID: ENST00000531863
  CDS Start-End: 402-2675
attactcctattgtgtaggttcccacctgcaagagtgctgtcgggtcctctgaggtgaaaccccaaaggaaagcgggatcgggactgggggagggggattcccaagtccctgacacccgcgccgtctcggcctgggcttggtgacctcgtcagtcccgtctgccgggactaggccgcggccaggccgggcacagcggtacccggtccggcgcgtgtgcggcctgctgacaaaaggccgagcccgcagggccaatccgcgcgccaccccgtagcgcctgggggcgggagcgggcgagccgagaagctcgtcttggcgcgtctattggctggtactgacgcccatccggaccccgaggccaggcagttggccaaggggggcggggttcgcagagccccaatgaatgggggagccggaagcaggaagtgagtttgcgaacggagcagctgctgcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatc

SEQ ID NO: 126984 - DNA, 595 bp, Homo sapiens
  Payload ID: 4886
  Gene Symbol: DPP3
  Gene Name: dipeptidyl-peptidase 3
  ENST ID: ENST00000533725
  CDS Start-End: 64-595
agtttgcgaacggagcagctgctgcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggccc

SEQ ID NO: 126985 - DNA, 3078 bp, Homo sapiens
  Payload ID: 4886
  Gene Symbol: DPP3
  Gene Name: dipeptidyl-peptidase 3
  ENST ID: ENST00000532677
  CDS Start-End: 402-2672
attactcctattgtgtaggttcccacctgcaagagtgctgtcgggtcctctgaggtgaaaccccaaaggaaagcgggatcgggactgggggagggggattcccaagtccctgacacccgcgccgtctcggcctgggcttggtgacctcgtcagtcccgtctgccgggactaggccgcggccaggccgggcacagcggtacccggtccggcgcgtgtgcggcctgctgacaaaaggccgagcccgcagggccaatccgcgcgccaccccgtagcgcctgggggcgggagcgggcgagccgagaagctcgtcttggcgcgtctattggctggtactgacgcccatccggaccccgaggccaggcagttggccaaggggggcggggttcgcagagccccaatgaatgggggagccggaagcaggaagtgagtttgcgaacggagcagctgctgcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccacca

SEQ ID NO: 126986 - DNA, 563 bp, Homo sapiens
  Payload ID: 4886
  Gene Symbol: DPP3
  Gene Name: dipeptidyl-peptidase 3
  ENST ID: ENST00000531314
  CDS Start-End: 294-563
gagaatgccccgggttggggaatccccgggttccaacggggctgtcagaccttcagtaaattgttgccctttccaagcctcagtttccctatctgtaaaatgggctttcttctggttgtgaacttctgtggcttccctggtggagcacagggagcgagcaggagaatggagggccaaggaaaaggcatttagagggatgagaatgggacagtttcaagcaaaatcatttattgctgtggatactttccgtccagggcgacttcatctgattagcgcacccacctgcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcag

SEQ ID NO: 126987 - DNA, 2251 bp, Homo sapiens
  Payload ID: 4886
  Gene Symbol: DPP3
  Gene Name: dipeptidyl-peptidase 3
  Uniprot ID: Q9NY33
  ENST ID: ENST00000530165
  CDS Start-End: 34-2157
gagtttgcgaacggagcagctgctgcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggg

SEQ ID NO: 126988 - DNA, 561 bp, Homo sapiens
  Payload ID: 4886
  Gene Symbol: DPP3
  Gene Name: dipeptidyl-peptidase 3
  ENST ID: ENST00000532019
  CDS Start-End: 250-561
agtgagtttgcgaacggagcagctgctgcagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatgga

SEQ ID NO: 126989 - DNA, 2676 bp, Homo sapiens
  Payload ID: 4886
  Gene Symbol: DPP3
  Gene Name: dipeptidyl-peptidase 3
  Uniprot ID: Q9NY33
  ENST ID: ENST00000541961
  CDS Start-End: 57-2270
aggaagtgagtttgcgaacggagcagctgctgcagtgatggttctcagcagggcccatggcggacacccagtacatcctgcccaatgacatcggcgtgtctagcctggactgccgtgaggccttccgcctgctgtcacccacagagcgcctctatgcctaccacctgtcccgtgccgcctggtacggaggcctggctgtgctgcttcagacctcccctgaggccccctacatctatgctctgctcagccgcctcttccgcgcccaggaccccgaccagctgcgccaacatgccctggctgaaggccttaccgaggaggagtatcaggcgttcctggtctatgccgcgggtgtttactccaacatgggcaactacaagtcctttggtgacaccaagtttgttcccaacttgcccaaggaaaagctggaacgggtgatcctagggagtgaggctgctcagcagcacccagaagaagtcaggggcctctggcagacctgcggggagcttatgttctctctggagccaaggcttcgacacctcggactggggaaggagggaatcaccacctatttctctgggaattgtaccatggaagatgccaaattggcccaggactttctggactcacagaacctcagtgcctacaacacccggctcttcaaagaggtcgatggagaagggaagccctactacgaggtgcggctggcttctgtgcttggctcagagccttccctggactctgaggtgacttccaagctgaagagctatgaattccggggaagccctttccaggtgacccggggggactacgcgcccatcctccagaaggtggtggagcagctggagaaagccaaggcctatgcagccaacagccaccaggggcagatgctggcccagtatatagagagcttcacccagggctccatcgaggcccacaagaggggctcccgcttctggatccaggacaaaggccccatcgtggagagttacatcgggttcatcgagagctaccgcgacccctttggttcccgaggagaatttgaaggtttcgtagctgtggtgaacaaggccatgagtgccaagtttgagcggctggtggcgagcgcagagcagctgctgaaggagctgccctggcccccaacctttgagaaggacaagttcctcacccctgacttcacctccctggatgttctcaccttcgctggctccggcatccctgccggcatcaacatccccaactacgatgatctgaggcagacggaaggctttaagaacgtgtcgctggggaatgtgctggctgtggcctacgccacgcagcgggagaagcttacctttctggaggaggatgacaaggacctgtacatcctctggaaggggccctccttcgatgtgcaggtgggcctgcacgagctgctgggccatggcagtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggctgatgcggaggacgtgatctacgtgaactggctcaacatggttcgggccgggctgctcgctctggagttctacacacctgaggccttcaactggcgacaggcccatatgcaggcccggtttgtgatcctgagagtcttgctggaggctggcgagggactcgttaccatcactcccaccacaggctccgatgggcgcccagatgcccgggtccgcctcgaccgcagcaagatccggtctgtgggcaagcctgctctagagcgcttcctgcggagacttcaggtgctgaagtccacaggggatgtggccggagggcgggccctgtacgaggggtatgcaacagtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccacca

SEQ ID NO: 126990 - DNA, 3904 bp, Homo sapiens
  Payload ID: 4887
  Gene Symbol: DPP4
  Gene Name: dipeptidyl-peptidase 4
  Uniprot ID: P27487
  ENST ID: ENST00000360534
  CDS Start-End: 562-2862
ctttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaa

SEQ ID NO: 126991 - DNA, 527 bp, Homo sapiens
  Payload ID: 4887
  Gene Symbol: DPP4
  Gene Name: dipeptidyl-peptidase 4
  ENST ID: ENST00000416189
  CDS Start-End: 1-260
atgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttcatatggcaaagtggatctttctctccttcttgaaatgctccctgccttggctactttttagtctcctttgacgattcctcttcctctgcccatatttttaaatgatgagtttggacattctatcaatgattattcaatatctcctgatgggcagtttattctcttagaatacaactacgtgaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaa

SEQ ID NO: 126992 - DNA, 2674 bp, Homo sapiens
  Payload ID: 4887
  Gene Symbol: DPP4
  Gene Name: dipeptidyl-peptidase 4
  ENST ID: ENST00000434918
  CDS Start-End: 142-654
gtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcaatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggttagcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggataagaaaatgaggcctacagattaagaaaatgaccaagtacgaatctatattcaaacctgactttctggcttgaacgaacaagctattagatactgcttcgtgtctccctctgtgtgattacagctggtgccctcagattcctgaaggcaccatcacagcagtacggaagcatccattttctctggagttgcattaagtacatcaggaaggctgtgggctgtgctccgtgggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttag

SEQ ID NO: 126993 - DNA, 578 bp, Homo sapiens
  Payload ID: 4887
  Gene Symbol: DPP4
  Gene Name: dipeptidyl-peptidase 4
  ENST ID: ENST00000413651
  CDS Start-End: 22-378
acttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttcatatggcaaagtggatctttctctccttcttgaaatgctccctgccttggctactttttagtctcctttgacgattcctcttcctctgcccatatttttaaatgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaac

SEQ ID NO: 126994 - DNA, 433 bp, Homo sapiens
  Payload ID: 4887
  Gene Symbol: DPP4
  Gene Name: dipeptidyl-peptidase 4
  ENST ID: ENST00000628861
  CDS Start-End: 77-433
cgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttcatatggcaaagtggatctttctctccttcttgaaatgctccctgccttggctactttttagtctcctttga

SEQ ID NO: 126995 - DNA, 3768 bp, Homo sapiens
  Payload ID: 4888
  Gene Symbol: DPP6
  Gene Name: dipeptidyl-peptidase 6
  Uniprot ID: P42658
  ENST ID: ENST00000332007
  CDS Start-End: 386-2797
tgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtt

SEQ ID NO: 126996 - DNA, 3710 bp, Homo sapiens
  Payload ID: 4888
  Gene Symbol: DPP6
  Gene Name: dipeptidyl-peptidase 6
  Uniprot ID: P42658
  ENST ID: ENST00000377770
  CDS Start-End: 142-2739
gcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtt

SEQ ID NO: 126997 - DNA, 2012 bp, Homo sapiens
  Payload ID: 4888
  Gene Symbol: DPP6
  Gene Name: dipeptidyl-peptidase 6
  ENST ID: ENST00000406326
  CDS Start-End: 404-1465
ggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaa

SEQ ID NO: 126998 - DNA, 4798 bp, Homo sapiens
  Payload ID: 4888
  Gene Symbol: DPP6
  Gene Name: dipeptidyl-peptidase 6
  ENST ID: ENST00000404039
  CDS Start-End: 588-2993
agttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatatcaacactcgtatactggatattacgtcctgagcaaaattcctcatggggatcctcaaagtctggacccaccagaagtcagcaatgcaaaacttcagtatgcaggatggggccctaaaggccaacagctgatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca

SEQ ID NO: 126999 - DNA, 2388 bp, Homo sapiens
  Payload ID: 4888
  Gene Symbol: DPP6
  Gene Name: dipeptidyl-peptidase 6
  ENST ID: ENST00000427557
  CDS Start-End: 54-2330
aactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatatttatttttgaaaacaatatctactactgtgcacatgtcgggaaacaggccatccgtgtggtctccactggcaaggaaggtgtgatttacaatggcctcagtgactggctgtatgaagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggctggaagtgagaaccccagcatttccctacacgttattggcttaaatggacccacccatgatctggagatgatgccgcctgatgatccacggatgagggagtactacatcaccatggtgaagtgggccaccagcaccaaggtcgccgtgacctggctgaaccgggcgcagaacgtgtccatcctcaccctctgcgacgccaccacgggggtctgcacgaagaaacacgaggatgaaagtgaggcctggctccacagacagaatgaagaacctgtgttctccaaggatggccgaaagtttttcttcatcagagccatcccccagggaggacgagggaaattctatcacatcacggtgtcctcgtcccagcccaacagcagcaacgacaacatccagtccatcacctccggggactgggacgtgaccaagatcctagcctacgatgagaaggggaataagatctacttcctgagcacggaggacctgcctcggagacgacaactctacagtgccaacacggtgggcaacttcaacaggcagtgcctctcctgtgacctggttgagaactgcacctacttcagcgcttccttcagccatagcatggacttcttcctgctcaagtgcgaaggtcctggtgttcctatggtgacggtgcacaacacaacagataagaaaaaaatgtttgacctagaaacaaatgaacatgtcaagaaggccataaatgaccgacagatgcctaaagtggaatacagggacattgagattgatgattacaacctgcccatgcagatactgaagccagcaaccttcaccgacaccacccactaccctctgctcctggtggtggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggacgatgctgaaggagcagtacattgacaggacgcgcgtggccgtgtttgggaaggattacggtggctacctgagcacctacatcctcccagcaaagggagaaaatcaaggccagacattcacctgcggctctgctctctctccaataacagacttcaaactctatgcctctgcgttttccgagaggtacttgggcctccatggacttgacaacagagcatacgagatgaccaaggtagcccatcgagtctccgcgctggaagaacagcagttcctgatcattcatcccactgccgatgaaaaaattcatttccagcacacagcagaactcattacacaactaattaggggaaaggctaattacagcttacagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgaggga

SEQ ID NO: 127000 - DNA, 1109 bp, Homo sapiens
  Payload ID: 4888
  Gene Symbol: DPP6
  Gene Name: dipeptidyl-peptidase 6
  ENST ID: ENST00000619756
  CDS Start-End: 234-1109
actaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggagctggtggggagtaaccctccgcagaggaattggaaaggaatagcaattgcactgcttgtcattctggtcatctgctccttgatcgtcacctcggtcatacttctgacaccagcggaagataatagtctgtctcaaaagaagaaggtcactgtagaagatctcttcagtgaagacttcaaaattcatgaccccgaggctaagtggataagtgatacagaattcatctacagagaacagaaaggaacagtgagactgtggaatgttgaaacaaatacttctactgtcttaatagaaggcaaaaaaattgaatcattaagagccatcagatatgaaatatctccagatagagagtatgcacttttttcatacaatgtggaacccatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtga

SEQ ID NO: 127001 - DNA, 1590 bp, Homo sapiens
  Payload ID: 4889
  Gene Symbol: DPP7
  Gene Name: dipeptidyl-peptidase 7
  Uniprot ID: Q9UHL4
  ENST ID: ENST00000371579
  CDS Start-End: 6-1484
gcgacatgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggccatg

SEQ ID NO: 127002 - DNA, 775 bp, Homo sapiens
  Payload ID: 4889
  Gene Symbol: DPP7
  Gene Name: dipeptidyl-peptidase 7
  ENST ID: ENST00000463619
  CDS Start-End: 1-733
cacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcaggtgcccttcccccggccccagatggctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggg

SEQ ID NO: 127003 - DNA, 478 bp, Homo sapiens
  Payload ID: 4889
  Gene Symbol: DPP7
  Gene Name: dipeptidyl-peptidase 7
  ENST ID: ENST00000470766
  CDS Start-End: 1-185
cctcgggctccgagcactgctacgacatctaccggctctaccacagctgtgctgaccccactggctgcggcaccggccccgacgccagggcctgggactaccagatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 127004 - DNA, 919 bp, Homo sapiens
  Payload ID: 4889
  Gene Symbol: DPP7
  Gene Name: dipeptidyl-peptidase 7
  ENST ID: ENST00000472306
  CDS Start-End: 1-362
cggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcgggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgcca

SEQ ID NO: 127005 - DNA, 1144 bp, Homo sapiens
  Payload ID: 4889
  Gene Symbol: DPP7
  Gene Name: dipeptidyl-peptidase 7
  ENST ID: ENST00000473532
  CDS Start-End: 1-467
agaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctgagcacaggactggaggggtctcaaggctcctcatggagtgggggcttcactcaagcagctggcggcagagggaaggggctgaataaacgcctggaggcctggc

SEQ ID NO: 127006 - DNA, 817 bp, Homo sapiens
  Payload ID: 4889
  Gene Symbol: DPP7
  Gene Name: dipeptidyl-peptidase 7
  ENST ID: ENST00000497375
  CDS Start-End: 1-817
gctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttccctcagcgcttcctggtgtcggacaggttctgggtccggggcgaggggcccatcttcttctacactgggaacgagggcgacgtgtgggccttcgccaacaactcggccttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaaggaagccctcccacctgtcctcccagccacctgctcagcttggatgtgcggccacactagcggcctttcccagtgagagctgcacccgcacctggcccagggttggaatttgtgggtctcagaagtgtcgtcctccttgtggcacctgtgggcccctgaggaggaaaagaggaaatggggtgttgggggcagcagccctaaccctgtgtccctcacccagttatggggggatgctcagtgcctacctgaggatgaagtatccccacctggtggcgggggcgctggcggccagcgcgcccgttctagctgtggcaggcctcggcgactccaaccagttcttcc

SEQ ID NO: 127007 - DNA, 3139 bp, Homo sapiens
  Payload ID: 4890
  Gene Symbol: DPP8
  Gene Name: dipeptidyl-peptidase 8
  Uniprot ID: Q6V1X1
  ENST ID: ENST00000300141
  CDS Start-End: 226-2874
gcaacgaaccggaagtgctaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaa

SEQ ID NO: 127008 - DNA, 3125 bp, Homo sapiens
  Payload ID: 4890
  Gene Symbol: DPP8
  Gene Name: dipeptidyl-peptidase 8
  Uniprot ID: Q6V1X1
  ENST ID: ENST00000321147
  CDS Start-End: 319-2862
ggatcgcaacgaaccggaagtgctaaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaa

SEQ ID NO: 127009 - DNA, 8699 bp, Homo sapiens
  Payload ID: 4890
  Gene Symbol: DPP8
  Gene Name: dipeptidyl-peptidase 8
  Uniprot ID: Q6V1X1
  ENST ID: ENST00000341861
  CDS Start-End: 1582-4278
agattccgagtcaaccaccgttcactgggcgccccttgagctctgggcgctggcctcctggcttccacgtccgttatcttaattgagtctcgctggggttgggaggccgggtattgtcagcgcttacagatgaggaaacggaagcccacagaggcgaagggattttccttaagtccgacttggcagatgggcttcggcctcagattttctggtttttcagctggtggtcttttttctctcctgcctcatgctaggtcgattccctccctgctcactgccctctcccattctgttccacccactcgcagcaggacactttcctttcctgccacacctgtcttctcacacacttttcttctaagacttggcattcctcccatctctcttctcaatattctctgctatgcctctcctcttgttcctcattcatagtttttcaaggtctttgccccctctgtgctattgaatctctcaactaggtgtggaccctaaagaatgagatagctaggcttcagtgaggctttaggtgtttaagtggacggctgtttggcccttgagttaaaaattaaggaatttcacttgagtggatccaaactcaagagtcctaaagctattttctgagtcaacatgctctatttctgagtgaggggcttagtgctatgaggtgtcttgacatcttagtccattgttgctgtgctggcataacctcgctgtttttcctgcacttgccacttagcttttcccaccccatcccttcatcacctacttgggctatgggagcccaaaattaaaacttatagagtaacagatgtaatagcagaccttcctttttttttttttcctaagccagaatttcaacaagtttaatgcttctttttccagaaaagttacctatttaaattattctcagagtaatgcagcaagaaaatggaatgcacttaagatgaatagaaaattgtttatctcgtgaaaagtcttaagttattaaattcaagttaattccctttctgcaaaaatggcctgtaactcttactggctatcctcctgagttaattctatctccatccagcttgatatgacattattatgtaaaagaggaacaggaataggcacataaaaataaattttattaatcatatgccgtttttgatgatttgcaatagtcactgagtaacttcacatctgtatgccttttgtaactttttaaagcctttccatggttttcctttgtctggacaccaaagtttgctatgttaggatattcttttgactatattgggctacacatctctgaaataaaataattcttgaattctgataacataaaacgcagatacaaaataatgtaggcattatatattgccccaaaaagtgatattttggtatcagttttaactactattttggggcttctctttttggccacatatggtccatcttaatgatcaaagtcttatcttatttcattatcctggtgagcaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaagacattagcaccatgtattcatactaccctattttcacttttaatagtattataaacttcatgaacttaattagtgtatttttacagtatacttttgagtttgttaaaatatgatgatattagtgattggtttggttcagttccagaatctttgactagttacagatttgatagcacttaaatgtaattgaatagcttatgcttcattgcttgggcatatccagcatgttatgaactaataactattaaacttgacttaaccagtcattcattaataatttttcaaggataacttagtggcctcctaaagacacttgttttggcactgaccagtttttagccaatttaatctgtatctagtataaataattctcatttttctttgatgatattaacagagtgggcttttccttttgcataaaggctagtaactgtatatgtagcatggatttaattagtcatgatattgataattacaggcagaaaatttttaatcaaatgattagagcttaaatatttgcaggcaagtttttttttttcctttaagaaaaggaaaaagtacacattcactagaattcttcagaaaatttagtggtgccagtttccatttggtatttccttattaaaatattctagaattttaaggagattgaagggaatcacagtggggtggggagacctgggtttggggaatgacagagagaagaggtggtgagggcctgattaaaaactaagcagaagtagttttaacaaaaatactcatgaaaatgtttggaaactgaaatttaaacaactgtaatattaaggaaaccagaatcaataaatcactgtcttgccagcacagctacagagtaacatgattcaggggaggaaaagttccttagagttacttttataattctttttttttttcctcttaggtttagaaatcttacaaatttaaactttatccttttaaaattatttgaacataatttagatattgtaagcttaaaatacaaatgtttatagataacctctttaccataaactaatccctggcaagccatggctctctttttttttttggtgtttaaagcctgtaaacagtttttctgaatgatcatgaacttttcttggtttagcactaggatttagctatgaagagagctcataggctttcaggtgctaattgagatctgccctgttagagtcttggggtgctagattggtcacattgacaccagtggcagggaaggcatctatgagtttgatgctttttatcacacacttcagtgtttagaaagttattaccaatacttttaaacaacactccaagaaaatttgctatatttctttctcatcactacagagagagtagatttccccatagagagcacagcctccattagtaaggttggtgactattggtaagaggtggacttcattgacaccaagtgggaggtagggaaagcccagaaatggcaggatgatatggtggttctgtcgttgggaaaggtattgggttttgctgtttgtatttatactgtataatagataccacgctttttcttattatctgtatatgtattgcttttcatgtttgatattttcccatgccaagatttgtttatatatattttcaatgttaaattaaattgatttgggtaactttcttccccaagaaagtattttcccccttaagtatatatctgactgtggagggtgttttgttttgttttgttttgttttgtttggactaactggcctcgaaggatctatccttataatatatgcaaagtagaaatggtatacagtagcttttaagcagctactccattgaaacctctcacccattaaggctgtttcttcaaagtggcatctcttattttaccgaaacaaacttagaaaacttcatgtactctggagttcacaggtgttttccttttgcatgttgccttctcctttcctcctatcacaaagaatgcttctattatcactcccagtcacttaaatgccattctgcttctttagcaggaaaaaatacctgaatgaattctcttacagaaagacagtttgactgaatttgctttttacaatcagtgtggaaaatatcatagtcaattgaggcaatcagtagaaatctcactaaaagtttgtaccccctgagtatgggtaacagcttaaacggcaagaatatataaaagtagcaacagtttagtgggagccaaaaagcactaggttaaatatcatactacgtttttaaagacttgataaatgtgtacacttgaacaaccatccagagggatagttacttgagcattacagagtagtggaactcaaaatctaagattcatctgggatacttctaaaagaaatgtagagttttgaatctcactcttaaaaatgtgtattcccaggctaggcatggtggctcacgcctgtaatcctagcactttgggaggccaaggcgggtgaatcacttgaagtcaggagatcaagaccagcttggtcgacatggtgaaaccccgtctctactaaaagtacaaaaaaattagctgggcatgatggcgtgtgcctataatcccacctactcgggaggctgaggcaggagaatcgcttgaacctgggaggcggaagttgcagtgagccgagatggcgccactgtagtccagtctgggcgacagagtgagattctgcctcaaaataaataaataaataaaaatttgtattccattgatttgggtagacaccaggaatgtgcatttctaacaagctttccaggcgatcctatagtaagtcatctgtggactactttaagaaactcttctatagagaatggagttggattaataataggtgattttttacactggactgattcacaagaacctaaacagtagtccatgaagctgctcatctgtggtaactatttggccccgtctcactctgaaagcagcaggagatgttgtttactttgtttctatcccctttgtctggagattaattttggaatgaaagtttttctctctatgccattcctggttcttttccaaagcctcatacaagaggattaggtcacaatgcatgcattaccttttaaaagaatgcgatattgataccgatgcttacttttttttttttactacttgttttattcctt[450 bp omitted]cttccttggtatagtggaggatttgaggattggaatatagagtagagtgcttgcttaagcctgggagcccatctttatagctatttgatgtaagaaaagagacatggccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaattga

SEQ ID NO: 127010 - DNA, 2822 bp, Homo sapiens
  Payload ID: 4890
  Gene Symbol: DPP8
  Gene Name: dipeptidyl-peptidase 8
  Uniprot ID: Q6V1X1
  ENST ID: ENST00000358939
  CDS Start-End: 207-2555
aaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattactaaaaaaaaaaaaaaaaaaaa

SEQ ID NO: 127011 - DNA, 3082 bp, Homo sapiens
  Payload ID: 4890
  Gene Symbol: DPP8
  Gene Name: dipeptidyl-peptidase 8
  ENST ID: ENST00000395652
  CDS Start-End: 113-2302
tcctggtgagcaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatggaagctttaaatgctaccttttagagatgccccatgtcctttctgctgctttgggaaatgatgagaatccgatgttccttttgcacagtaaggcagttactgtgtttgccagtgttattggacatgctgaggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatg

SEQ ID NO: 127012 - DNA, 1083 bp, Homo sapiens
  Payload ID: 4890
  Gene Symbol: DPP8
  Gene Name: dipeptidyl-peptidase 8
  ENST ID: ENST00000558559
  CDS Start-End: 1-1083
ggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacgga

SEQ ID NO: 127013 - DNA, 906 bp, Homo sapiens
  Payload ID: 4890
  Gene Symbol: DPP8
  Gene Name: dipeptidyl-peptidase 8
  ENST ID: ENST00000558529
  CDS Start-End: 249-906
aaggagagccttttataaaagctaccaaagggatttataggcactgtgaagtagacctgacctcaatttttttttaatttcatttttaaactgaacacagagaagggagagctgttgcttttcttactaagtttcattgcagctgtgctaaaaagcatttttttcttgccctccccactcccccgctttttttttgaccctctcagagaatcattctgataatagaagatagacccgtgaacagcttcatgtgccttgtttttctaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccag

SEQ ID NO: 127014 - DNA, 564 bp, Homo sapiens
  Payload ID: 4890
  Gene Symbol: DPP8
  Gene Name: dipeptidyl-peptidase 8
  ENST ID: ENST00000560665
  CDS Start-End: 313-564
taaagcctccgaggccaaggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggtgcagtatccgcccccttctccttctcctgcgccggcgaggcctgggccacggctcaccaggccctttccgcctcacggagggactgctcggcgcgttctcagggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctat

SEQ ID NO: 127015 - DNA, 592 bp, Homo sapiens
  Payload ID: 4890
  Gene Symbol: DPP8
  Gene Name: dipeptidyl-peptidase 8
  ENST ID: ENST00000560436
  CDS Start-End: 233-592
gtgcagagccggtggtgcccttcccccctcccccccacttgccggaagaggaagccgaggctctgagattccgagtcaaccaccgttcactgggcgccccttgagctctgggcgctggcctcctggcttccacgctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaa

SEQ ID NO: 127016 - DNA, 2953 bp, Homo sapiens
  Payload ID: 4890
  Gene Symbol: DPP8
  Gene Name: dipeptidyl-peptidase 8
  Uniprot ID: Q6V1X1
  ENST ID: ENST00000559233
  CDS Start-End: 113-2809
tcctggtgagcaggctttgatggtgaggaaaggaaagattcctgtgagaagagcaggatgagcagagggattctatgcttgaagtcgagtcacttgaaaaagatctctttgaatgtggaagagatctgagcagatgaaaataaaatcaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcaggcaacactggactatggaatgtattctcgagaagaagaactattaagagaaagaaaacgcattggaacagtcggaattgcttcttacgattatcaccaaggaagtggaacatttctgtttcaagccggtagtggaatttatcacgtaaaagatggagggccacaaggatttacgcaacaacctttaaggcccaatctagtggaaactagttgtcccaacatacggatggatccaaaattatgccctgctgatccagactggattgcttttatacatagcaacgatatttggatatctaacatcgtaaccagagaagaaaggagactcacttatgtgcacaatgagctagccaacatggaagaagatgccagatcagctggagtcgctacctttgttctccaagaagaatttgatagatattctggctattggtggtgtccaaaagctgaaacaactcccagtggtggtaaaattcttagaattctatatgaagaaaatgatgaatctgaggtggaaattattcatgttacatcccctatgttggaaacaaggagggcagattcattccgttatcctaaaacaggtacagcaaatcctaaagtcacttttaagatgtcagaaataatgattgatgctgaaggaaggatcatagatgtcatagataaggaactaattcaaccttttgagattctatttgaaggagttgaatatattgccagagctggatggactcctgagggaaaatatgcttggtccatcctactagatcgctcccagactcgcctacagatagtgttgatctcacctgaattatttatcccagtagaagatgatgttatggaaaggcagagactcattgagtcagtgcctgattctgtgacgccactaattatctatgaagaaacaacagacatctggataaatatccatgacatctttcatgtttttccccaaagtcacgaagaggaaattgagtttatttttgcctctgaatgcaaaacaggtttccgtcatttatacaaaattacatctattttaaaggaaagcaaatataaacgatccagtggtgggctgcctgctccaagtgatttcaagtgtcctatcaaagaggagatagcaattaccagtggtgaatgggaagttcttggccggcatggatctaatatccaagttgatgaagtcagaaggctggtatattttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcaggtgcagttggtgaataatcggtttaaaggagtcaagtatttccgcttgaataccctagcctctctaggttatgtggttgtagtgatagacaacaggggatcctgtcaccgagggcttaaatttgaaggcgcctttaaatataaaatgggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgc

SEQ ID NO: 127017 - DNA, 1182 bp, Homo sapiens
  Payload ID: 4890
  Gene Symbol: DPP8
  Gene Name: dipeptidyl-peptidase 8
  ENST ID: ENST00000558786
  CDS Start-End: 1-935
attttgaaggcaccaaagactcccctttagagcatcacctgtacgtagtcagttacgtaaatcctggagaggtgacaaggctgactgaccgtggctactcacattcttgctgcatcagtcagcactgtgacttctttataagtaagtatagtaaccagaagaatccacactgtgtgtccctttacaagctatcaagtcctgaagatgacccaacttgcaaaacaaaggaattttgggccaccattttggattcagcaggtcctcttcctgactatactcctccagaaattttctcttttgaaagtactactggatttacattgtatgggatgctctacaagcctcatgatctacagcctggaaagaaatatcctactgtgctgttcatatatggtggtcctcagggtcaaatagaaattgacgatcaggtggaaggactccaatatctagcttctcgatatgatttcattgacttagatcgtgtgggcatccacggctggtcctatggaggatacctctccctgatggcattaatgcagaggtcagatatcttcagggttgctattgctggggccccagtcactctgtggatcttctatgatacaggatacacggaacgttatatgggtcaccctgaccagaatgaacagggctattacttaggatctgtggccatgcaagcagaaaagttcccctctgaaccaaatcgtttactgctcttacatggtttcctggatgagaatgtccattttgcacataccagtatattactgagttttttagtgagggctggaaagccatatgatttacagatctatcctcaggagagacacagcataagagttcctgaatcgggagaacattatgaactgcatcttttgcactaccttcaagaaaaccttggatcacgtattgctgctctaaaagtgatataattttgacctgtgtagaactctctggtatacactggctatttaaccaaatgaggaggtttaatcaacagaaaacacagaattgatcatcacattttgatacctgccatgtaacatctactcctgaaaataaatgtggtgccatgcaggggtctacggtttgtggtagtaatctaataccttaaccccacatgctcaaaatcaaatgatacatattcctgagagacccagcaataccataagaattact

SEQ ID NO: 127018 - DNA, 677 bp, Homo sapiens
  Payload ID: 4890
  Gene Symbol: DPP8
  Gene Name: dipeptidyl-peptidase 8
  ENST ID: ENST00000559526
  CDS Start-End: 190-677
ggccgctgctactgccgccgctgcttcttagtgccgcgttcgccgcctgggttgtcaccggcgccgccgccgaggaagccactgcaaccaggaccggagtggaggcggcgcagcatgaagcggcgcaggcccgctccatagcgcacgtcgggacggtccgggcggggccggggggaaggaaaatgcaacatggcagcagcaatggaaacagaacagctgggtgttgagatatttgaaactgcggactgtgaggagaatattgaatcacaggatcggcctaaattggagcctttttatgttgagcggtattcctggagtcagcttaaaaagctgcttgccgataccagaaaatatcatggctacatgatggctaaggcaccacatgatttcatgtttgtgaagaggaatgatccagatggacctcattcagacagaatctattaccttgccatgtctggtgagaacagagaaaatacactgttttattctgaaattcccaaaactatcaatagagcagcagtcttaatgctctcttggaagcctcttttggatctttttcagcaacaacctttaaggcccaatctagtggaaactagttgtcccaacatacggatggatccaaaattatgccctgctgatccagactggattgcttttatacatagcaacgatatttg

SEQ ID NO: 127019 - DNA, 4295 bp, Homo sapiens
  Payload ID: 4891
  Gene Symbol: DPP9
  Gene Name: dipeptidyl-peptidase 9
  Uniprot ID: Q86TI2
  ENST ID: ENST00000262960
  CDS Start-End: 279-2957
aggccgccgcctgggtcgctcaacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgt

SEQ ID NO: 127020 - DNA, 408 bp, Homo sapiens
  Payload ID: 4891
  Gene Symbol: DPP9
  Gene Name: dipeptidyl-peptidase 9
  ENST ID: ENST00000599248
  CDS Start-End: 207-408
atagggtggtgctaggtggagaaagcccatcacaggctagccctcgctccctcactcttgcgccagcctctctgcaatccgggctgtgcccccgggtagaagagaggtcagcggagggccaggctccagcaccaagcctcggcctgtctggaagctcaagctaaagagtctagccacatccagaagattcctggaagtttctcgcgatgtttcatttcatttctcatctccgggatcgaatttttgcttcttgggctatcagtggtgatcagagcttctcgctgaattccgagggggctgagaggatggccaccaccgggaccccaacggccgaccgaggcgacgcagccgccacagatgacccggccgcccgcttccaggtgcagaagcactcgtgggacgggctcc

SEQ ID NO: 127021 - DNA, 542 bp, Homo sapiens
  Payload ID: 4891
  Gene Symbol: DPP9
  Gene Name: dipeptidyl-peptidase 9
  ENST ID: ENST00000598041
  CDS Start-End: 255-542
acacgcgaaaggtccccggttcgatcccgggcggaaacagacatttttatgggatttaaaaaaattttccgtgattgatggctcacgcctgtaatcccagcactttgaaaggccgaagagggcggatcacctgaagtcagagttcgagaccagcctggccaaaatggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccc

SEQ ID NO: 127022 - DNA, 798 bp, Homo sapiens
  Payload ID: 4891
  Gene Symbol: DPP9
  Gene Name: dipeptidyl-peptidase 9
  ENST ID: ENST00000601720
  CDS Start-End: 1-661
cctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggc

SEQ ID NO: 127023 - DNA, 555 bp, Homo sapiens
  Payload ID: 4891
  Gene Symbol: DPP9
  Gene Name: dipeptidyl-peptidase 9
  ENST ID: ENST00000593973
  CDS Start-End: 495-555
ttcccacttcctccaagcaagcagcgacttccccaagccaagctgttggtcccggaggacagggcttctggcaaggtcggcagtcactcggagcccacaaagggaagcgagaccagccccggtgccaccctttccagaccactggctctcgcagaactgggtcactgcggccatgtttagatttctgtaaaacaaatatttgcctggccagtccagtcaggtcaaggagtgtgctaagtgacgagggcgggagtggggtggtgggagatgtgacaccgcggcggccactcacggtggctgctttgcggacccagagtgtcctgagtgggaggagagagtgggatattctttggggaagggcgtgccattcaccctttcacctgcacctcccacatcccgaggctctggaacttccagtgaaggccaagcatctccccggctggacagcaagccaacagcacagcttctcgctgaattccgagggggctgagaggatggccaccaccgggaccccaacggccgaccgaggcgacgcagccgccacagatgacccgg

SEQ ID NO: 127024 - DNA, 3098 bp, Homo sapiens
  Payload ID: 4891
  Gene Symbol: DPP9
  Gene Name: dipeptidyl-peptidase 9
  Uniprot ID: Q86TI2
  ENST ID: ENST00000598800
  CDS Start-End: 507-3098
cctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaaggctctggaacttccagtgaaggccaagcatctccccggctggacagcaagccaacagcacaggtgaccaggatggattttcattccttcacgcccgggcctctcccgagacccagcatgtctccccgcgagcccactgagagataatcattccacagtgctccgtggaatgcctgccacgtgccagccaccagctaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctga

SEQ ID NO: 127025 - DNA, 742 bp, Homo sapiens
  Payload ID: 4891
  Gene Symbol: DPP9
  Gene Name: dipeptidyl-peptidase 9
  ENST ID: ENST00000600556
  CDS Start-End: 236-424
gagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagacggagtcttgctctgttacccaggctggagtgcagtggcacgatcttggctccctgcaacctccatctcccgggttcaagcgattcttctgcctcagcctcccaagtagctgggagtacagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctc

SEQ ID NO: 127026 - DNA, 626 bp, Homo sapiens
  Payload ID: 4891
  Gene Symbol: DPP9
  Gene Name: dipeptidyl-peptidase 9
  ENST ID: ENST00000598360
  CDS Start-End: 269-626
gcttctctcccagattctgtccagggcatgcagacagtgctgcagggcttcaaggcagagctagaatctagccaggtagaatcgggcctgacagtctgcagctcctgagtgggggaggctgaacggctggccggtgcttccattaacctgccacattcatgacatgtttatcctataaaggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgaga

SEQ ID NO: 127027 - DNA, 600 bp, Homo sapiens
  Payload ID: 4891
  Gene Symbol: DPP9
  Gene Name: dipeptidyl-peptidase 9
  ENST ID: ENST00000601130
  CDS Start-End: 368-600
aacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaagctgcccctggaaggagctttttgaaggctttgaggagaggaaggggagagtgctgatttcagcaggatttggtggaggggtgcctggatccacctacactgcctgacccggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgt

SEQ ID NO: 127028 - DNA, 835 bp, Homo sapiens
  Payload ID: 4891
  Gene Symbol: DPP9
  Gene Name: dipeptidyl-peptidase 9
  ENST ID: ENST00000599163
  CDS Start-End: 1-456
ggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatagttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaag

SEQ ID NO: 127029 - DNA, 423 bp, Homo sapiens
  Payload ID: 4891
  Gene Symbol: DPP9
  Gene Name: dipeptidyl-peptidase 9
  ENST ID: ENST00000595327
  CDS Start-End: 1-423
gggaggttttggcgaggcacggctccaagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggccccc

SEQ ID NO: 127030 - DNA, 3851 bp, Homo sapiens
  Payload ID: 4891
  Gene Symbol: DPP9
  Gene Name: dipeptidyl-peptidase 9
  Uniprot ID: Q86TI2
  ENST ID: ENST00000594671
  CDS Start-End: 1-2511
atggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatagctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccaacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgtca

SEQ ID NO: 127031 - DNA, 2025 bp, Homo sapiens
  Payload ID: 4891
  Gene Symbol: DPP9
  Gene Name: dipeptidyl-peptidase 9
  ENST ID: ENST00000597849
  CDS Start-End: 166-1722
cgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatttccaggccacgccccaccatggggtctactctcgggaggaggagctgctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctgcgggtgtggccaccttcgtcatacaggaagagttcgaccgcttcactgggtactggtggtgccccacagcctcctgggaaggttcagagggcctcaagacgctgcgaatcctgtatgaggaagtcgatgagtccgaggtggaggtcattcacgtcccctctcctgcgctagaagaaaggaagacggactcgtatcggtaccccaggacaggcagcaagaatcccaagattgccttgaaactggctgagttccagactgacagccagggcaagatcgtctcgacccaggagaaggagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaaggtgagcagagcctgacgaatgctgtcgactcatcgcgttagtcacgtgtggttcaatatgctgtttgttcattggtcggcccccccactcagccagcacaccctgcgggagaaggaacagggatcggcaggaagccagccttccccagtgactgcatgatctggcagggcttagagcacccaactgttggcttattcaggcagcagatttactgagcacctcccctgtgccaggcccttagcacaaccaggggttggccacctacggcccacaggtcaaatccggcccaccacctgtgttcataaataaagttttattggcactgagccacagccacttgttta

SEQ ID NO: 127032 - DNA, 625 bp, Homo sapiens
  Payload ID: 4891
  Gene Symbol: DPP9
  Gene Name: dipeptidyl-peptidase 9
  ENST ID: ENST00000600621
  CDS Start-End: 205-625
ttcctctgctgggtcccaggggaatcggggcccgtgggatggcttctctcccagattctgtccagggcatgcagacagtgctgcagggcttcaaggcagagctagaatctagccaggtctgtgtcccacgcctgcagctggaatggaggctctctggaccctttagaaggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaaggtccggaaagaggctctgctgctcctgtcctggaagcagatgctggatcatt

SEQ ID NO: 127033 - DNA, 728 bp, Homo sapiens
  Payload ID: 4891
  Gene Symbol: DPP9
  Gene Name: dipeptidyl-peptidase 9
  ENST ID: ENST00000597900
  CDS Start-End: 1-188
cagagatcttccatttccacacgcgctcggatgtgcggctctacggcatgatctacaagccccacgccttgcagccagggaagaagcaccccaccgtcctctttgtatatggaggcccccaggcccgtcctgcccggcatctcgtgctggactgctggccctcacctccccacaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctcc

SEQ ID NO: 127034 - DNA, 566 bp, Homo sapiens
  Payload ID: 4891
  Gene Symbol: DPP9
  Gene Name: dipeptidyl-peptidase 9
  ENST ID: ENST00000602161
  CDS Start-End: 198-566
gggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggcacccctgccctcctgaggtcagctgagcggttaatgcggaaggttaagaaactgcgcctggacaaggagaacaccggaagttggagaagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggaatgccatatggcagccgagagaactccctcctctactctgagattcccaagaag

SEQ ID NO: 127035 - DNA, 570 bp, Homo sapiens
  Payload ID: 4891
  Gene Symbol: DPP9
  Gene Name: dipeptidyl-peptidase 9
  ENST ID: ENST00000597726
  CDS Start-End: 366-570
aacttccgggtcaaaggtgcctgagccggcgggtcccctgtgtccgccgcggctgtcgtcccccgctcccgccacttccggggtcgcagtcccgggcatggagccgcgaccgtgaggcgccgctggacccgggacgacctgcccagtccggccgccgccccacgtcccggtctgtgtcccacgcctgcagctggaatggaggctctctggaccctttagaaggcacccctgccctcctgagggagcggaaacgcctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgtcctggatgaccccaagtctg

SEQ ID NO: 127036 - DNA, 5433 bp, Homo sapiens
  Payload ID: 4892
  Gene Symbol: PPIP5K1
  Gene Name: diphosphoinositol pentakisphosphate kinase 1
  Uniprot ID: Q6PFW1
  ENST ID: ENST00000348806
  CDS Start-End: 1-4221
atgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctagggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggttagagacaaggttttgccatgttggccaggctggtttagagctcctgacctcaagtgatctgcctgcctcggcctcccaaagtgctgggattacaggcgtgagccaccgcacccagccagacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 127037 - DNA, 5586 bp, Homo sapiens
  Payload ID: 4892
  Gene Symbol: PPIP5K1
  Gene Name: diphosphoinositol pentakisphosphate kinase 1
  Uniprot ID: Q6PFW1
  ENST ID: ENST00000334933
  CDS Start-End: 148-4374
aggttcggctgcgcgagcggagggaggcggttccctcttatgcttttcatctccatccccagccccacccacagccagggggcttgggttctgagctgatggggtacccccctctgcagagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 127038 - DNA, 5559 bp, Homo sapiens
  Payload ID: 4892
  Gene Symbol: PPIP5K1
  Gene Name: diphosphoinositol pentakisphosphate kinase 1
  Uniprot ID: Q6PFW1
  ENST ID: ENST00000360135
  CDS Start-End: 127-4347
gcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctagggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggttagagacaaggttttgccatgttggccaggctggtttagagctcctgacctcaagtgatctgcctgcctcggcctcccaaagtgctgggattacaggcgtgagccaccgcacccagccagacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 127039 - DNA, 5565 bp, Homo sapiens
  Payload ID: 4892
  Gene Symbol: PPIP5K1
  Gene Name: diphosphoinositol pentakisphosphate kinase 1
  Uniprot ID: Q6PFW1
  ENST ID: ENST00000360301
  CDS Start-End: 127-4353
gcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 127040 - DNA, 5487 bp, Homo sapiens
  Payload ID: 4892
  Gene Symbol: PPIP5K1
  Gene Name: diphosphoinositol pentakisphosphate kinase 1
  ENST ID: ENST00000381879
  CDS Start-End: 59-4288
aggttcggctgcgcgagcggagggaggcggagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatccccttgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaa

SEQ ID NO: 127041 - DNA, 5596 bp, Homo sapiens
  Payload ID: 4892
  Gene Symbol: PPIP5K1
  Gene Name: diphosphoinositol pentakisphosphate kinase 1
  ENST ID: ENST00000381885
  CDS Start-End: 95-4384
tgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 127042 - DNA, 5636 bp, Homo sapiens
  Payload ID: 4892
  Gene Symbol: PPIP5K1
  Gene Name: diphosphoinositol pentakisphosphate kinase 1
  Uniprot ID: Q6PFW1
  ENST ID: ENST00000396923
  CDS Start-End: 123-4424
gactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctctgttatctcaggtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 127043 - DNA, 589 bp, Homo sapiens
  Payload ID: 4892
  Gene Symbol: PPIP5K1
  Gene Name: diphosphoinositol pentakisphosphate kinase 1
  ENST ID: ENST00000439195
  CDS Start-End: 1-589
tgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctgctggatgaccagcaccctgtggtccggttgctgcgcagtttttcctctgactgtacagggggccggccagtctccttggatgccacgctggcgcatcacctgcaccagtgctcctaccacctgcgcctcttccggaactggctgcgctcaggccaggatgaccccgagtgcctctacgggtttgaagggtgttccatggtgcctaccatctaccctctggaaacactgcataatgccctttccctacgtcaagtgagtgaattcttgagtagagtctgcca

SEQ ID NO: 127044 - DNA, 535 bp, Homo sapiens
  Payload ID: 4892
  Gene Symbol: PPIP5K1
  Gene Name: diphosphoinositol pentakisphosphate kinase 1
  ENST ID: ENST00000417085
  CDS Start-End: 193-535
cggagggaggcgggactcaagagtagccttcctcgaggacctgcctttcccatttgctgcctgaagttaatgtttcttgctggccaaatcagggacatgccggcattccccacccacagccagggggcttgggttctgagctgatggggtacccccctctgcagagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaag

SEQ ID NO: 127045 - DNA, 5718 bp, Homo sapiens
  Payload ID: 4892
  Gene Symbol: PPIP5K1
  Gene Name: diphosphoinositol pentakisphosphate kinase 1
  Uniprot ID: Q6PFW1
  ENST ID: ENST00000420765
  CDS Start-End: 205-4506
accgcaaagaagtcgcgctttgattgggccgctgtcaggtgtcgctgcctgcaggttcggctgcgcgagcggagggaggcgggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggagggaggtgtaccggatcctgcaggaagagggtattgatctgcctcgatatgctgtgctcaaccgtgatcctgcccggcctgaggaatgcaacctgatagaaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggtccatccccacggaggctgaggacattcccattgttcccaccacatctggcactatgatggaacttcgttgtgtcattgcaattattcgtcatggggatcgtactcccaagcagaagatgaagatggaagtgaaacacccaaggttttttgctctgtttgaaaaacatggtggctacaagacagggaaattaaaactcaagcgacctgagcagctccaggaggtgctggatatcacaaggctgttgttggctgaactggagaaagaaccaggtggtgagatcgaggagaagactggaaaactagagcagctgaagtctgtactggagatgtatggtcacttctcaggtataaaccggaaggtacaattgacttactaccctcatggagtaaaagcttctaatgaggggcaagatccacagagggaaactctggccccatctctgttgctggtactgaagtggggtggagaactgactcctgctggccgtgttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctctgttatctcaggtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgccctttccctacgtcaagtgagtgaattcttgagtagagtctgccagcgccacactgatgcccaggcacaggcatctgcagccctctttgattccatgcacagcagccaggcctcagataacccattttctccaccacgtactcttcattcacctcccctgcaactccagcagcgctctgagaagcccccttggtacagcagtggcccttctagcactgtgtccagtgctggtccttcttcccctactacagtagatggtaactcccaatttggcttcagtgatcaaccctccctaaattcacacgtggctgaagaacatcaaggccttgggctgctccaggagacccctgggagtggagcacaagagctctccatagaaggggagcaagagctttttgaaccaaatcagtccccacaggtgccacctatggaaaccagccagccatacgaggaggtcagccagccatgtcaggaggtccctgacatcagccagccatgccaggacatttctgaggcgctcagccagccatgtcagaaggtccctgacatcagccagcaatgccaggagaaccatgacaatggtaaccacacatgccaggaggtccctcacatcagccagccatgccagaagtccagccaactgtgccagaaagtctctgaggaagtttgccagctatgtctggagaactccgaggaggtcagccagccatgccagggggtctctgtggaggttggcaagctggtccataagttccatgtaggggttggtagcttggtccaggaaacccttgtagaagttggcagcccagctgaagagatccctgaggaggtcatccagccataccaggagttctctgtggaggttggcaggctggcccaggagacttctgcgatcaatctgttatctcagggcatccctgagattgataaaccatcccaagagttccctgaggagattgatctgcaggcccaggaggtccctgaggagataaattagaagtcctgggtggtccctgaagtgattgatcagctgcctggagagggtattcctcaagcccagcatccatctggtgatccaaaccctcagagccagtctctagcccatgaccagcactcaccccttccaccagcaacatgtgattaattttctcattagtggtatcacactataccagccatttgagccagcaaccttttctgttggctaactcactggccagctctcaccagcggtgtctggggaagtagttctctttgtatgaagcatacctgtgccagagctgtggttgaggaggagccagttttaggttcgaagaagccattggctcctcacttagccattagacttgaataggatttccttggggtgggttggtctgtcattacccagccttctctgagcatcctaggaaatcacagattgttaaaggaaatgccgcttcactgctgaagacaccatctggcgacagcaaatgcaaaagaggggactctagggtcttcacttttctggggaaatgttcacgacttctcaaggtacgcttagaccatatgtgcattcaggggactcttgtctttgccagcactcctcaggtgagcccgggatggctatctgaaatgtctggaaaatagagtcccttccccaaacatctgacatggccactaaatctttagacttgccttatagatccttccatatcatccccaagtgccccttctgcctcagtcctgttcctctgggcaatagctctagggaaaagtaggtattagactgctgtgcaaaattcagagcaactacttaaaatgctctagaggattcttagccagtctgtgaaagtgggcctcctctgtggtggggctgtttggcttaggagatgctgtagtagtagagataatcaggttctattttaagcaatcagcagagatcaatattgtacagatacaagcaaaggtttaataaatatatatatatatatttatttctgtagttgtgccagggacagactggccaaagaccaaacactgcagggtccccaagaaatttgtccttatatcattgtgtctgagggccagatatgattatgaagctttttccaaagatccagggatgggaatgggagtgggtaggaggggtaatgcggtcattggagtcgggggctggaacattatgagtgctcaataaatataaactaatgagaatggtggtgatgga

SEQ ID NO: 127046 - DNA, 506 bp, Homo sapiens
  Payload ID: 4892
  Gene Symbol: PPIP5K1
  Gene Name: diphosphoinositol pentakisphosphate kinase 1
  ENST ID: ENST00000429176
  CDS Start-End: 164-506
ttcgtgacccggagctgtgcgaggagagtaccgaggagggggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaag

SEQ ID NO: 127047 - DNA, 268 bp, Homo sapiens
  Payload ID: 4892
  Gene Symbol: PPIP5K1
  Gene Name: diphosphoinositol pentakisphosphate kinase 1
  ENST ID: ENST00000431962
  CDS Start-End: 54-268
cggctgcgcgagcggagggaggcggagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgac

SEQ ID NO: 127048 - DNA, 796 bp, Homo sapiens
  Payload ID: 4892
  Gene Symbol: PPIP5K1
  Gene Name: diphosphoinositol pentakisphosphate kinase 1
  ENST ID: ENST00000453080
  CDS Start-End: 397-796
ggcggtgggggagtggctggggctgggggcggtatcggaccgggtgggcgcggtagagtgggcttggtgggttcccagggctggggttcgttccgggtgggctccgctttgggaagaggcccagcggaggggccttagtgtcagcgtagggagagtgaggcggcgaaggcgggggcgggcaaaggctagtggagtcgggatgcgagggcggtattcgtgacccggagctgtgcgaggagagtaccgaggagggggtcggcgggagaggagataggactcaagagtagccttcctcgaggacctgcctttcccatttgctgcctgaagttaatgtttcttgctggccaaatcagggacatgccggcattagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatca

SEQ ID NO: 127049 - DNA, 777 bp, Homo sapiens
  Payload ID: 4892
  Gene Symbol: PPIP5K1
  Gene Name: diphosphoinositol pentakisphosphate kinase 1
  ENST ID: ENST00000437065
  CDS Start-End: 1-777
gtcttccactgttgcggaagatactacttgacctgcagagaacccacgaggatgagtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggccttccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatg

SEQ ID NO: 127050 - DNA, 572 bp, Homo sapiens
  Payload ID: 4892
  Gene Symbol: PPIP5K1
  Gene Name: diphosphoinositol pentakisphosphate kinase 1
  ENST ID: ENST00000427877
  CDS Start-End: 1-356
agccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaagggtgagctgtgggcatactcagtgatgctatgtacctgcaggtgtatacagtggggccagattatgcccatgctgaagctagaaaatctccagctttggatgggaaggttgaacgagacagtgaggggaaagagattcgatatccagtcatgctgactgccatggaaaagctggtggccaggaaagtctgcgtagctttcaagcaaacagtttgtggatttgaccttcttcgtgccaatggtcattcctttgtgtgtgatgtcaatggctttagttttgtcaagaactcgatgaaatactacgatgactgtgccaagattctggggaacaccataatgcgggagcttgccccacagttccagattccatggt

SEQ ID NO: 127051 - DNA, 15407 bp, Homo sapiens
  Payload ID: 4893
  Gene Symbol: PPIP5K2
  Gene Name: diphosphoinositol pentakisphosphate kinase 2
  Uniprot ID: O43314
  ENST ID: ENST00000321521
  CDS Start-End: 574-4242
gactgatcatttggctcttgccggaaatcgttccgcccggtgaggtttcggcgtgagacccgaggagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaagagacttaaatggtaaatttttaaaattttcttatctcttactttttagttttcaaagtagaaaaaatcaggaatttttttattaactagtacttacatattaaataaaatttattattggctatatacatagcaatatattactttccaaactagaaagtacagtacaactaactttttccattgttatgcaagaactattactttcctgtagtcaccaaactcagtagtattgctctgtagactagacactctatttgtaaaaatcttagaatcactttccaaaacaaataaaaagtctactgtatcagagcaaaatgttatagttatcactgtttagtggcagtttgactgaagcatctgtttctcacttgattctgtcctgagaagatgtgggattttttggttttaaatactagaagatatttcttcttagagcccagtcctccatcccaaagaggtgaactagcccagcatgaagaattgtctagtcaccctgagatattaatcttcataatgtattattcagttccttcacccttaaaagccatataataggctcagacctaacttagcccttgaagtctagtgctggcagattctgctgccctggtttaaatgagttacgtagtccattctcaaatactagcaaatttggggggcgtggtacagcaattttgggtgaagaaaagtgtgctgaacaccttatgtcagtgatagacaagatatagaggctgaagggaatacagtaaagtaacaaaaacatgtggcagtgtgcttagcataaacatagagcacaaaggcaatagatggaaattatgagagaaaagttaaagttcttcaagaaatatccaattaaaactcactagccaaggaaaaagtttctgttttcacccggatttctttttgggttgactctgtctgacctaaatgtccactgttaactagtgccatgccagtttgaaccaagatttcacatttttgttttgtattcatactttggtagaaatttctcagtctttgtgtatttataagaatttgctttacacatagtgtacagtgtttattaactttacatcattttatccttgccttactatctggacagtgtagactgcctatattcttagttggggttgggatctcttctcttagagtggcccagcagttttagcccctctctaattctcttttcctgtgttgggagatatcaaaacaacagaattcttgccagtgggaacatttttcttttttagacaaggtctcattctgtcaccccagctggagtgcagtggcacagtcttaattcactacagccttgaactcctgggctcaagaaatctttctgcttcagcctcctaaatagctggtactataggtgcgtgccaccacacccagctcatgggaataatttttacactccttcagaaggagtcatttgtgattggagtccacatagaaacaggtttccctctgtacataatcgtaggtaccaaaatattactgtgtaaagtgttgtttatataggtcaatttttgtggaagatctaatttctattttcagagaacagagcacattaaaaaatctatttagtattgtgtactatataatctatgtgaattatagctccttaactaaatatattactgagttttttttttaatactgtaagttctagggtacatgtgcacaatgtgcaggtttgttacataggtatacatgtgccatgttggtttgctgcacccatgaactcatcatttacattaggtatttctcctaatgctatccctcccccagccccccacccactgacaggcccagtgtgtgatgttccccgccctgtgtccaagtactgttctcattgttcagttccctcttatgagtgagaacatgcggtgtttggttttctgtccttgtgatagtttgctgagaatgatggtttccagcttcatccatgtccttgtcatccttttttttggctgcatagtattccatggtgtatatgtgccacattttcttaatccagtctatcattgatggacatctgggttggtcccaagtctttgctattgtgaatagtgccacaataaacatacgtgtgcatgtgtctttatagtggcatgatttataatcctttgggtatatacccagtaatgggatggctgggtcaaatggtatttctagttctagatccttgaggaatcgccacactgtcttccacaatggttgaactaatttacactcccaccaagtgttcctatttctccacatcctctccagcatctgttgtttcctgacttttcaatgatcgccattctaactggcgtgagatggtatctcatttgtaagatgatatctcattgagatttttataaactgcttttcttttggttcatgtgctttgtcatggattgtgagaaaaacatcttttcgcttagggatcactgtcaatttctccttttattatcaatggtttttactttactttttatatagtatgtgggtatgttttctggtgcatataaattcatgaatgctagattttcattataggttttaccttatcattattaaaatgtcctttttgtccattggatactttttgttctataaattgtcagatattaagattatgacctatgctttattttggcttgcatttgcctgatattcatctttttactttttggtatttgtgtcactttgttttaggttatttaatatagtatatattgggttttgctttgtgattcaattttaagatcccttttacttaatagattagtgtagtctgttttatgtaatgtatctttgcttttagattgtgcttgctttttttattgctttaaaattcttttgtctttctgtaacaatactttccactgcaagtaggaaaattccaattgaaactggtttaaatcatcagaaaatgtattattacacatttctgaaggtccaaaggtggggttggcttcagccacagttgcattagccatattgtcatcaaaagcccaagtgacctcccttgtcacctctggcatagtataaactttatcccaaagttgttttctctcgtgttaacaataattgctgtcggtttcagtgaggactacatattttttttgttcatgtccaacacaataaaaattgagggaagttctgtcccaatcctggaatattaatattaagccatctacttcagtgtgattgagccaacttctttgatcatctactcacccctagataaatagaatactccaggagattcccatgaccttactgaccctagagcagatgatggagtcagtttttccgaaaagcctcagcactgttgacattttggaccataaaattctacatcataggaagctgttccatgcatagcagcatgtctagtaggatctctgtacctagctgtgaagtgttgagagtcagttaaggtaagtagctgaaatgaaaataacaatcacatctttattcacttactatgataaaattataagcaagagaccaaaaaggaaagtagggccagctccttgttgttccatttttcccctaccatggactagcactggacatgcgtcaatcagacgacatgcagtccaggcagaggaaattgtttcactgctaaggagcaatgaacaaaaggttcctgccatcttatggacctcaaggactgcggacagggagcagggaagggttagaagtagaaaacaactgagtcagagtggagatgagtgtctcagtcaaggcccaccaatagcgaggtctctgtggaggcacctgaaaagtgtctcaaccaaggccccctgataaggaagactcagcatggaggtacctggtctaggaatgcagctaggtttatagacatggccagcccagggggtcctgagcaccagatacaactccctccagagactggctgtgtttaaatctcatgtgggaagggcacctttcccctacaaagcctgtcaggcaaagcctttgtaattgcttatggtcaggcctgaaagatcacacatcagactttggcctggaacatatctcctcaccctaaatgccagcagcatcgcctccaaactgtggcagtcaaaaatgtctccagacattagtaaatgtcttttgtgagggaagaattgaccctagttaagaaccactgccctaaagcacatgattctgtggaaaagaaggatatatgaccaaaatcatcattttggatagtgagggcatggataatggatacataatcagcaatgtatgctgtatactacacttgcattatgttattcacatttgctatagttcacttgttgtgctaatggttttttccttcactatgattttgaattatatttaattttaaagtctatatatatatatatatagatcctatctgttgactccttgctgtgaacaatatccaattagtgtattttttcctctactgcacagttttggttgattattttttccttttcatttcttttctgaactttgttagcttatgttgcatttcctttggttgttttgctatggtgtttctgatcaactacatttctttatgaactctatttccttaagttctttgagttatgacagtatatttggtcacatttttcatgtgctcagctgattcattctttcctgttgagtggtttttatctgctaattgtttctgcttgttccatttctccttttcttgaagtgtttgtgcatgaacactgtgcaggtttattttcaagtattacttacctttatatgagataaatttctttctggctcatctatttgatacaatttcttttttgtttgtttttgttttgtttttgttgttttttaaaatgcaatttcatatgttaggtaggttggcttttctttttctttttctttttttttttgagatggagttttactcttgttgcctaggctggagtgcagtggcatgatctcagctcactgcaacctccaccttccagtttcaaatgattctcctccctcagcctccagagtagctgggattacaggcgcccgccaccacgcctggctaatttttgcatttttagtagagactgggtttcaccatgttggccaggctggtctcgaactcctgacctcatgatcttcctgcctcagcctcccaaaatgctggaattacaggcatgagccatcatgcccggccgtaggttggcattttaagctcacacaatcctaccaaggtgacagtgaatctccttatgacaggattgtgggtctgagagagctgttgtagccttttactctctccagtcaacaaagattggcaactacagggttaccacctttggagtctctttcctcctgtctgccacgtctacagactactgcttgtcaatgtgatatgcatgtattttcttcttcagctttgcccctcctgccactgtaccagacaatatccaggaaatcccctactactgacactcatcccatttccattgttttagagaaggaactagttgttgttgtttttttttccctgtctcagattatgtcatctattttggagtattttggtctaatgactttggctgcgatatggagctatctgacctttactgcacctggcagctctatctcctattttggggttgaggttaaagtgtcttctagttttgttgaagatagtttatgtttctcttcatatttgatgataattttttaaattaagacctaatttctccttcattttcaaactggatatcatttcttttgtggttaatattctttgacaagaaggaagaggaggaggaagaagaacaaaagaagcctgcctctctttagactgcccatctcaattatattttaaaaatgaagttaatatctgtcctgctaacagtagtgttgtcagaatcaaatgaaataatatttggtaaactataaagtgaagaccaaatttgaaggactatttgtttttgttgtaatagagttgtatatagtccagatgtcaaccaggcctcttcagcatttttatagtcaaagatgtacaagatagctcctaatgctcttttatggctgctcctgttgccagggcaacagcctgcctagtaacaatctaacagacaccccccaaaaaccaaaaaataaaggttattctagcatcttctccttttaaaaatctttaaaataagagaattcagttcttcccaaagcagtgtttaaaaaaaaaaagtatttaaataaaatcaaggataccatcccacccacctatcttacattttgtgtggtatgagtggcaccattgtgtgacccaggtaggatagtggatgtacagtttagatacccattttaaagcagttagaaagatgtaacttgacaaggaaagcagtctcttttgtcattctacatttagtgcttcaggagtacttgatatatggaaggatttttttaaaaaaaaggaaaaatgaatatgccttcagaaagttttttgctgcttttaaaagccatagatttgtcttaagttagtcaatgctgaatagaaagcttgatgataaaggtgggtgggtggatggatggatggatgaatgaaggaaaaattaggagaaaagagaaagcagaggaggggtgagacagagaacaaaagaacacaggctctactgttaacaaaaagcagcatcgctgatgtgtggggaataaattggaagtcatatcattacgacttttttttcatgccacatagatatgctgatttgtccaacaatgcctgtactcaaaagtcatgacaataaaatgagacctgggagtcccaaatgttattaactaccacaattttatataactgattcttcactggtcatccagaagcctttttgaaagtcccactgccatacctgcctcctcggtgaaatagatgtaaaagccacaaagagagaatcaatgagccacactcatattggaagcgaatggagttgacttcaccagtgggaaaagcaattacttttcaaagtgaaaactgatcaattcacaactcaaggaaagcatggagtaatttcagaactccagtaagaagtgataaatgtctagtttggaatcatgtggctgaaaatcttaccatatgctttccacaggctgagcaagaggatagatcattgaatagatgctttaattccatttttgacaatgaaccttgtgcttctgaaaatatttatatttaaccatgaggttatgatgattttttctctacactttttgagaagcctcttcagaaaagagcaaagttgtctgctctaatggatagaataaggagctgggagaaaggagacctgggtattaatctcagctctaccactacatggtagagctatgtagtggtagactatctgggagactctagaatctttaccattccctctactattcctagctcccttttctttcatagtcaacaagtgctttttgaacaattattgaggtaaataacataccctaaaagttagtactgattcccattatcatgctctgttgttccctggatgctcttttgaggaatttacttggttaatacagttaatagtataatacttataataacaattttgagaattatcagcatgagacaatttatttgcataatagctttttgttattatccagaatacatttagttctggattttgtttgatattgtgaatgcaaactatttttttgtgttagcctaaataaaatgaaatacagttatggaaatatttctgctgcaagaaaagaattacatacaactagtatacatatttagaggtgctgtagtcttctagactgtaaaggcagatggccgtgagtggaaatctgagtgtataggatgtgtttcgtgttcccactgcatatgcattattacccttgtctgagtggttgtttaaactgacatctgtaaaactaatctgtaaagtgagatctgggttctgacctatctcttacagtccataatgttgtgattctaagaatatttcattccttactgctttctgccctccattctgaccaatgctgcaaccacaaataaaaacattacttaccctatgagaaagactagaccttatactcattttatcttaacagtttattataactcattttgaccactcctccctcaaaaaaaattgtccctagaaaactagagtgatcatagggatcagatgacatgttactgggtgaagccaggaagctaccatatacatagaaaagttagttgccaaatatggtgtgggaatttgggaggaatttatctgctcaaaaactctcacctacttactagatatagtgtttgtaatgttagccttggagattctaccttaaaaatatcattgagaaagctcagagaactcccaggtaaacacacaggtagccccttctaaaatgcaaatgccctttgaaggccagctttattaatcttgccattaaccccatagttaatcatatgcatttctcacagtgacctgaaaacaggcattccttctctaaatgtgtgctgaatgctggttataaaccagttactacactaagccctgatgatacaaatatgaaaagtcctgtttccagggaatttactttctaatgaggaaccaagtgctcaaaagcagtcataaagttcatggcaaaataacccacataattaactgctttgttacaaaaacttggaaatatagataaaatatttattttggaaatatatgttacaggtgaaaagcaagaattaaaactagttatctgaatgtaaaaggaatcaacggctaaatcaagcttaaagtcttcctgtccaagggatatgaaaggtacctcaacctttggttttggttttggttttggttttgtttttttggtcaacatgaattatagctaggggaagagataaacagggggttaggttgtagattatatgcatgacagattgctggaattgggctccattcacaaaggagggagcaggaaagggtttctcttgactggaccacaaatataaaatctcatgccctctcattatcttgataagccctataggtccataaaagaaataaaatgccaaaacataccatgaggacactttcacaatccagggcacacacatgactcccgcaataggaaaccacactgaagacattctcacaatttaaaacaagttgtaaactacaggaaacagttggcatcccaggagagttgttgcctgaggaactagatggtggtatgttattctggcatatagggaacagaataagacatgagggtaggaagaggtttttaaaagcaaagttaggcattcaatgatgacttcataaatgtgcctgggctggcctttaatggaaggctttaatttagggaacttaaagaatttcataatattggagtataaactgctggaaataaggatgctatttaatagactctcttagatttttcataaaatgctaatagaatcccaaaggaagtgtgtattctaaaatgttattgtgtatgttataaaagctttgtaaaataaagtgatgttaagctactattgtaaagttaaaaattttttcagtcatctgtaatctcattacccaagtaaaactgttttcatttttccatta

SEQ ID NO: 127052 - DNA, 5813 bp, Homo sapiens
  Payload ID: 4893
  Gene Symbol: PPIP5K2
  Gene Name: diphosphoinositol pentakisphosphate kinase 2
  Uniprot ID: O43314
  ENST ID: ENST00000358359
  CDS Start-End: 510-4241
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatc

SEQ ID NO: 127053 - DNA, 5842 bp, Homo sapiens
  Payload ID: 4893
  Gene Symbol: PPIP5K2
  Gene Name: diphosphoinositol pentakisphosphate kinase 2
  Uniprot ID: O43314
  ENST ID: ENST00000414217
  CDS Start-End: 285-3953
gtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaagagacttaaatggtaaatttttaaaattttcttatctcttactttttagttttcaaagtagaaaaaatcaggaatttttttattaactagtacttacatattaaataaaatttattattggctatatacatagcaatatattactttccaaactagaaagtacagtacaactaactttttccattgttatgcaagaactattactttcctgtagtcaccaaactcagtagtattgctctgtagactagacactctatttgtaaaaatcttagaatcactttccaaaacaaataaaaagtctactgtatcagagc

SEQ ID NO: 127054 - DNA, 505 bp, Homo sapiens
  Payload ID: 4893
  Gene Symbol: PPIP5K2
  Gene Name: diphosphoinositol pentakisphosphate kinase 2
  ENST ID: ENST00000515845
  CDS Start-End: 331-505
tttagagggcagtcctttggggaaccttggaaccacggtcagaaaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaac

SEQ ID NO: 127055 - DNA, 1516 bp, Homo sapiens
  Payload ID: 4893
  Gene Symbol: PPIP5K2
  Gene Name: diphosphoinositol pentakisphosphate kinase 2
  ENST ID: ENST00000507921
  CDS Start-End: 160-1516
gagacccgaggagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttca

SEQ ID NO: 127056 - DNA, 683 bp, Homo sapiens
  Payload ID: 4893
  Gene Symbol: PPIP5K2
  Gene Name: diphosphoinositol pentakisphosphate kinase 2
  ENST ID: ENST00000507310
  CDS Start-End: 1-630
aaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaagggattcctcatgttttgtaacaacaacatctttagcagtctgaagcctatggactcttttttaagagtagtgtttttaaatgctttaaacatgtaagattatgatggagacaaattttattcaaatataataaaatatttaaaaaccaa

SEQ ID NO: 127057 - DNA, 2799 bp, Homo sapiens
  Payload ID: 4893
  Gene Symbol: PPIP5K2
  Gene Name: diphosphoinositol pentakisphosphate kinase 2
  ENST ID: ENST00000509597
  CDS Start-End: 1-1197
tatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgttgtatctgaaaatgctaattacctgagaacaccaagaactcttgtggaacagaagcagaatcctactgtaggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaagagacttaaatggtaaatttttaaaat

SEQ ID NO: 127058 - DNA, 479 bp, Homo sapiens
  Payload ID: 4893
  Gene Symbol: PPIP5K2
  Gene Name: diphosphoinositol pentakisphosphate kinase 2
  ENST ID: ENST00000504275
  CDS Start-End: 152-307
aggagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcagatggagtcttgctctgttgcccaggctggagtacaatggcacgatctccactcaccgcaacctccacctcctggatttgagtgattctcctgcttcagcctcctaagtatctgggattacaggatttccactggacaaagcggttgcctatgcaaaactcaggaatccatttgtaatcaatgacttgaatatgcagtatctcatacaagataggagagaagtatatagtattcttcaagctgaaggtatttt

SEQ ID NO: 127059 - DNA, 765 bp, Homo sapiens
  Payload ID: 4893
  Gene Symbol: PPIP5K2
  Gene Name: diphosphoinositol pentakisphosphate kinase 2
  ENST ID: ENST00000511022
  CDS Start-End: 1-765
aaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggac

SEQ ID NO: 127060 - DNA, 473 bp, Homo sapiens
  Payload ID: 4893
  Gene Symbol: PPIP5K2
  Gene Name: diphosphoinositol pentakisphosphate kinase 2
  ENST ID: ENST00000502481
  CDS Start-End: 300-473
ccgaggggcttgtgctggagagaatgacagcctgggcgtggagtgacagtacagctttgagggtcctttcgcgccttgatttctcctcctgctcccccatggcttccctttttcatttcttgggttcgagacgccagaaattgaagatcagctaaaagggaaccgctgagcttctaccccacgctgtgcctggctccactgaagtgattagcctcgagttatgggactgctgatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccattt

SEQ ID NO: 127061 - DNA, 1070 bp, Homo sapiens
  Payload ID: 4893
  Gene Symbol: PPIP5K2
  Gene Name: diphosphoinositol pentakisphosphate kinase 2
  ENST ID: ENST00000613907
  CDS Start-End: 1-1070
ttcttcgctatggtgccttatgcaataccaatgattctcagaatgaagatggaggaatggtgaaggagatggaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtaggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaa

SEQ ID NO: 127062 - DNA, 4933 bp, Homo sapiens
  Payload ID: 4893
  Gene Symbol: PPIP5K2
  Gene Name: diphosphoinositol pentakisphosphate kinase 2
  ENST ID: ENST00000613674
  CDS Start-End: 384-4220
aacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaataccaatgattctcagaatgaagatggaggaatggtgaaggagatggaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatgaacacctacacctctataggtgctggtccgtttcctctgtggaatttctaggctccagtggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaac

SEQ ID NO: 127063 - DNA, 6010 bp, Homo sapiens
  Payload ID: 4893
  Gene Symbol: PPIP5K2
  Gene Name: diphosphoinositol pentakisphosphate kinase 2
  ENST ID: ENST00000627916
  CDS Start-End: 285-4121
gtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaataccaatgattctcagaatgaagatggaggaatggtgaaggagatggaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatgaacacctacacctctataggtgctggtccgtttcctctgtggaatttctaggctccagtggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaagagacttaaatggtaaatttttaaaattttcttatctcttactttttagttttcaaagtagaaaaaatcaggaatttttttattaactagtacttacatattaaataaaatttattattggctatatacatagcaatatattactttccaaactagaaagtacagtacaactaactttttccattgttatgcaagaactattactttcctgtagtcaccaaactcagtagtattgctctgtagactagacactctatttgtaaaaatcttagaatcactttccaaaacaaataaaaagtctactgtatcagagc

SEQ ID NO: 127064 - DNA, 2221 bp, Homo sapiens
  Payload ID: 4894
  Gene Symbol: DPH1
  Gene Name: diphthamide biosynthesis 1
  Uniprot ID: Q9BZG8
  ENST ID: ENST00000263083
  CDS Start-End: 46-1377
gtctgcgctctccgcgttcttccagcgctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcctgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggattttg

SEQ ID NO: 127065 - DNA, 1747 bp, Homo sapiens
  Payload ID: 4894
  Gene Symbol: DPH1
  Gene Name: diphthamide biosynthesis 1
  Uniprot ID: Q9BZG8
  ENST ID: ENST00000570477
  CDS Start-End: 277-1368
atttctatgcttgagcgggggcaccggcaggccctgaaaagggatccctattccatctcaatctggcttcagccaaagacagacaccaactcaggccttatatccattctaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcctgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcat

SEQ ID NO: 127066 - DNA, 1733 bp, Homo sapiens
  Payload ID: 4894
  Gene Symbol: DPH1
  Gene Name: diphthamide biosynthesis 1
  ENST ID: ENST00000571418
  CDS Start-End: 1-1295
gcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcctgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcaccc

SEQ ID NO: 127067 - DNA, 1644 bp, Homo sapiens
  Payload ID: 4894
  Gene Symbol: DPH1
  Gene Name: diphthamide biosynthesis 1
  ENST ID: ENST00000575667
  CDS Start-End: 1-644
gcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaagttcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcctgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcaccc

SEQ ID NO: 127068 - DNA, 2013 bp, Homo sapiens
  Payload ID: 4894
  Gene Symbol: DPH1
  Gene Name: diphthamide biosynthesis 1
  ENST ID: ENST00000571710
  CDS Start-End: 1-446
ctttgggccgccagggcagtcctaagatcctggagcacctggaatctcgactccgagccttgggcctttcctttgtgaggctgctgctctctgagatcttccccagcaagcttagcctacttcctgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccttggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcggtgagacaagccccgctccggaaacgcactcagtttcctccatcttgtttcgtccccctcgacacccttcagcatcccccaccctgcgtccacccgcattcctcccacccagtccacacccttcatttctcgcgacccataccctctttgctcaaactgcagcctgtcctcccaggcttccgccttcaccgtcttcctccgctgtctcctgttcaggccaatccactcatttcccccctctcatttcccccagacttttgcctcgattccctttttctctctgtcatctcgaaccctcctgccctttctcatttctttccttcctggagcctcccatgccctaatcccatcctttttcctcatatcgctgtagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttgg

SEQ ID NO: 127069 - DNA, 558 bp, Homo sapiens
  Payload ID: 4894
  Gene Symbol: DPH1
  Gene Name: diphthamide biosynthesis 1
  ENST ID: ENST00000570833
  CDS Start-End: 1-150
accattgtggatatcttggaaaggttcacggaggccgaagtgatggtgatgggtgacgtgacctacggggcttgctgtgtggatgacttcacagcgagggccctgggagctgacttcttggtgcactacggccacagttgcctgagctgaagccactgcgcctggctgctcagagacctgagcctggccgggccctctgctgctcctgccttcccaaacagcccctgaactcctccctcccacagttcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtc

SEQ ID NO: 127070 - DNA, 775 bp, Homo sapiens
  Payload ID: 4894
  Gene Symbol: DPH1
  Gene Name: diphthamide biosynthesis 1
  ENST ID: ENST00000607788
  CDS Start-End: 1-311
ggtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatt

SEQ ID NO: 127071 - DNA, 657 bp, Homo sapiens
  Payload ID: 4894
  Gene Symbol: DPH1
  Gene Name: diphthamide biosynthesis 1
  ENST ID: ENST00000575162
  CDS Start-End: 1-324
ctacgctggcagctccttggggccctggacggtgaaccacggccaggaccgccgtccccacgccccgggccggcccgcgcgggggaaggtaggcgggggcttccaggagggaggagagaccgcgcctgggcactggccgccgccctgcgaccgcgacgggaaacgcacaggagcggagcggagggaaacgcagggtcgcaggagcgagaccctaaccaaagtctgcgacctcaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggccct

SEQ ID NO: 127072 - DNA, 557 bp, Homo sapiens
  Payload ID: 4894
  Gene Symbol: DPH1
  Gene Name: diphthamide biosynthesis 1
  ENST ID: ENST00000263084
  CDS Start-End: 1-159
gggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcaggtatcagcccccgctctgggtgcgccccgccttttgccgttgtcatgggaacgccttggcgctccgaggcccgccctcggggcggtgctgacgttcggttccgccccgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcctgccctccggaggagcagc

SEQ ID NO: 127073 - DNA, 3052 bp, Homo sapiens
  Payload ID: 4895
  Gene Symbol: DPH3
  Gene Name: diphthamide biosynthesis 3
  Uniprot ID: Q96FX2
  ENST ID: ENST00000383775
  CDS Start-End: 94-267
gatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatattccttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagaaatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcc

SEQ ID NO: 127074 - DNA, 3131 bp, Homo sapiens
  Payload ID: 4895
  Gene Symbol: DPH3
  Gene Name: diphthamide biosynthesis 3
  Uniprot ID: Q96FX2
  ENST ID: ENST00000488423
  CDS Start-End: 97-345
gatgatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagagacaaccatttatgatttgctgttctgtaagagtgtggattctttctatcaactgctgatatcatcttcaggaagcaagtccataacatgacatatctggattttgtgcttagaaccttaaattggaagcattcttaattatgcatctaaatttaaaagaagataatttcaaaacagtgctttctttcccttggtttcatcattttcatatcttaaaccaaattacttcggtatctgacaacagcatcatctacctcagtcattaggatttcttaataaaaaagagattgtatttttgacttggttattaagattattaaaattagcccttcctttgaaatatgacatcagctttgctgttctaaatttaaaattagttgcttcatcagtaccacacttccagtttctataccaagccagtctcctcagttttcccattagaatggacatgttctgttcagcgtgtcatttctgtaatgcttcatgcagagagtttggtcatagtattaaagagaaaatacagtgaggtcacaatgtctccagagctaaaagttagtgaacaagaaagaaagtccaaaatgaagtgatgaaagaatgaggacttttcttatattctgcatattccttggaagtcaggacaagatgaaaagaaaaacatccaaaagaagtgaaattggtgacagaatgagaggagcaaagcataccagtgtagtaagtggaatgtttgaatgactttgccaggtcagagcaagtaatatttctgtatctgagtttttgtttgtgttttgataaggctaatgaaattgcattccaggtaggggttaacgtcaaatttccatggctggtagctgtgcttttggcatatcacagtgttgtgtcactactacaaggtaaagcatctacagcggagaatgagcttgaaaatgagagacctattgtgaataaatatgcccatgagagcatatttaataagcctctataacatgcagccaaaccagacattcactcctgcagagaaatgttgccctggagaaaaagaaatatataaagataggctatcacccttcttttgctgcagtactaagcatagcaagaaattagaatcatttacattggaaatttgaaaattccctttatatacacaactttactgtgtataaataaaaaatatttattaatgcagtgatgtccgtcaggttgttttaggaatggcttctgcaattagaaaaatagcttgctagaatgtaaatgttctgttactggtaaatgtactgcacacattcattggacgttaaaacaagtgagtagccttttttacctgccagcagcatggctgtgtgcagccactaggctgagacaataaattaccaaaaattataatgtaccgagctgaaaatgctcagtacattatgtggcatattctggatgtgatgagaaatctcattgccatttgggacactgacatcccagaagtaatccacaactgctttgcaaaagcaaagtgactgctcagatgaacagagcagagtactcactcactatggtggcatcagctgcaaagcaaaatgaactgtcccatgatcatgttgatggttttctagatactgccaacatgttagctctttctgatgctgatgagtttcaaacacgaacagacacccttgatgtgggtttgctaagaacatagaagaacaggaagaaaagttgccaggttcacacatcccaggaaaaaagaagcataaaaagcattagcagtcagtgactgatgataatgctgcaataatgggaatggttttgtttctaaaccaaattatttctaaatcaaatcatttattgctttgtttctaaagcaattgagtcactaagtttgtgaactgtaggagaacacatcaagattgaatcctgtgttaagcagaaggtaaaaccagagccaggcgcagtggctcgtgcctgtaatcccagctactcaggaagctaaggcaggaggatcatgtgaggccaggagttcaagactagcctgggcaacatagaaagaccctgtctctaaaaaatcttcttttaattagcaaggtgtggggccttgagcaaattgcttgggcccaggagtttgaggctgtggtgagctgtgatcacaccactgcgttccagcctgtgtgacagggcaagacctcatgcctaaaaaataaagagaaagcagagtaaaactggactctgagatacgactaaagttctgtgtgatacgtgtgccttatttagctcaagacattcctggagcacctataaaaactgacttgtaatccaggctatgtctctttttagcttcgtaatctttggcaaggccattggattcttcagctgtacaattaggagactcgatcaggtgattgcctttctcagctgtcagttctctaatttcaggcttggtagcttgtaggaactgaaattgcaattaaaacctttataaactcaaactaaatcatgaattacagaaaaagtccattcttccaaaacttgatgttaccacacttacaagtttaaaatatgaagtcgactgtttaaaggattctgcatatattctagtgtgcacattcagaaacatttttcttggaaaaagtacccaacattttttataactgcacatattaatttattgccagaataaattgcattgcatgctaaataaagtcagataattcaaatcca

SEQ ID NO: 127075 - DNA, 1143 bp, Homo sapiens
  Payload ID: 4896
  Gene Symbol: DPH5
  Gene Name: diphthamide biosynthesis 5
  Uniprot ID: Q9H2P9
  ENST ID: ENST00000342173
  CDS Start-End: 105-959
cgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatga

SEQ ID NO: 127076 - DNA, 1316 bp, Homo sapiens
  Payload ID: 4896
  Gene Symbol: DPH5
  Gene Name: diphthamide biosynthesis 5
  Uniprot ID: Q9H2P9
  ENST ID: ENST00000370109
  CDS Start-End: 114-971
cggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 127077 - DNA, 609 bp, Homo sapiens
  Payload ID: 4896
  Gene Symbol: DPH5
  Gene Name: diphthamide biosynthesis 5
  ENST ID: ENST00000427040
  CDS Start-End: 125-265
gacatcaaagtaaaggagcagtctttggaaaatctaatcaacagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatt

SEQ ID NO: 127078 - DNA, 1034 bp, Homo sapiens
  Payload ID: 4896
  Gene Symbol: DPH5
  Gene Name: diphthamide biosynthesis 5
  Uniprot ID: Q9H2P9
  ENST ID: ENST00000488176
  CDS Start-End: 127-984
ccggcgcttttgcagttgcttctgcggaaaggtggtagttaagaatttgtaaaggccagagaactacctacgattctctcagcgggtaattggctgctcctagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattg

SEQ ID NO: 127079 - DNA, 1018 bp, Homo sapiens
  Payload ID: 4896
  Gene Symbol: DPH5
  Gene Name: diphthamide biosynthesis 5
  ENST ID: ENST00000617698
  CDS Start-End: 117-848
gcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatcatttggacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggatttgaacatagatattaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggtttta

SEQ ID NO: 127080 - DNA, 1847 bp, Homo sapiens
  Payload ID: 4897
  Gene Symbol: DPH7
  Gene Name: diphthamide biosynthesis 7
  Uniprot ID: Q9BTV6
  ENST ID: ENST00000277540
  CDS Start-End: 159-1517
ccccggaaggagtcgcgagagaggcggcccgcgctgacggtgtccctggggctctgcgctcgtccggccggccccggcctcgccgccccgcgcagtacccagcccggccccgccgacccgcctctactgccggctccgcgcccttccccgagggctggatgatgggctgtttcgccctgcaaacggtggacaccgagctgaccgcggactcggtggagtggtgcccgctgcaaggctgcaggcacctgctggcgtgcgggacctaccagctgcggcggccggaggaccggcctgccggcccccagaacaagggtggaatggaagttaaggagcctcaggtccgtttaggccgtctcttcctgtacagtttcaatgacaacaactctattcaccctctggtcgaggtccaaagaaaagatacttctgcaatcctggacatgaaatggtgtcacatcccggtggctggacatgccctcttgggcttggcagatgccagtggatccatacaactgctccgcctggtggaatctgagaagagccacgtgctggagccattgtccagccttgccctggaggagcagtgtctggctttgtccctagattggtccactgggaaaactggaagggccggggaccagcccttgaagatcatcagcagtgactccacagggcagctccacctcctgatggtgaatgagacgaggcccaggctgcagaaagtggcctcatggcaggcacatcaattcgaggcctggattgctgctttcaattactggcatccagaaattgtgtattcagggggcgacgatggccttctgaggggctgggacaccagggtacccggcaaatttctcttcaccagcaaaagacacaccatgggtgtgtgcagcatccagagcagccctcatcgggagcacatcctggccacgggaagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttg

SEQ ID NO: 127081 - DNA, 1014 bp, Homo sapiens
  Payload ID: 4897
  Gene Symbol: DPH7
  Gene Name: diphthamide biosynthesis 7
  ENST ID: ENST00000615714
  CDS Start-End: 1-684
atgggacaggtctctgggagacgttctgtgccccccaggggccttgtggaacaggtgagcctggctttccttatatgcctcctgtggttggtcggtttcagctatgatgaacacatcctactgtgggacacacgaaacatgaagcagccgttggcagatacgcctgtgcagggtggggtatggagaatcaagtggcaccctttccaccaccacctgctcctggccgcctgcatgcacagtggctttaagatcctcaactgccaaaaggcaatggaggagaggcaggaggcgacggtcctgacatctcacacattgcccgactcgctggtgtatggagccgactggtcctggctgctcttccgttctctgcagcgggccccctcgtggtcctttcctagcaacctaggaaccaagacggcagacctgaagggtgcaagcgagttgccaacaccctgtcatgaatgcagagaggataacgatggggagggccatgccagaccccagagtggaatgaagccactcacagagggcatgaggaagaatggcacctggctgcaggctacagcagccaccacacgtgactgtggcgtgaacccagaagaagcagactcagccttcagcctcctggccacctgctccttctatgaccatgcgctccacctctgggagtgggaggggaactgagcttgaaatcatgaagccccttcccacaaggaaaccaggagggagactgcgagtgagtgcccgggaccacctcatcagagatgcttactgcagccctgcaggtgcctgtgcactgatggaatccacagtgtagtcagaaaagctgttgacttctcttaaatcagcttccctgctgggcccctgaaagtggactgggtgattctgtctggcagagagtggggaaaagacgcggtttccagcttgcagatttgttaagtttctcaggcagattttgactttcagcctttcatacttgtttaagcaactatttgtattaaatgaagttttttg

SEQ ID NO: 127082 - DNA, 2099 bp, Homo sapiens
  Payload ID: 4898
  Gene Symbol: DPH6
  Gene Name: diphthamine biosynthesis 6
  Uniprot ID: Q7L8W6
  ENST ID: ENST00000256538
  CDS Start-End: 28-831
gccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaaggtgtcctcagtgcctgacaactacagaacatctaattatatatataatttttgaaaagtgttttggaacattgttcattaaaccaccatttctatacaaaaaaattgcatagtattttctcagttactatgactagtttatttttttctcatgactcttatttttttagagaaacatactttcactagaagaggttagtggaaccatttattaattgggaaaatgtcgacggcatgttcattaatagtgccaactttcttggaattcactctttctctttcgttaacacatcttccctatgaccttttttttcttttatttcatctataaaccccatttctgtagcatttctttttttatcacactagtttcttttcctccttctctctttcttgctccaatccctaccaataatgtcatgatgcagaggcatttgaaaatgaagatgaaaagatggtcactttatttagccagtcaagcttattctactgggtgtcgccaaagcgatttatcatttttattttaaatatattcatggttgaagtgtttcaacgttattggacaattaggaagaatgtccttaactcttacaagttattttataactgatttttaaaatgctgtttttcagtattaactatgttgaccttagaaaacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccacatttcatttgtccatgcacctattgaagaacatctcagttgcttccatgttttggcgattatgaataaagcgactataaacatccatg

SEQ ID NO: 127083 - DNA, 3648 bp, Homo sapiens
  Payload ID: 4898
  Gene Symbol: DPH6
  Gene Name: diphthamine biosynthesis 6
  Uniprot ID: Q7L8W6
  ENST ID: ENST00000440392
  CDS Start-End: 52-549
acctcctggctcccgcccgcgctcgccgcacgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaagggcatcactagaatgaccttgcttgctgaatatgatgctctgaatctccaagattttcacatgcatttgaaagtgggcagccaggcgattgtttacaggactccaaatgaactgtgcactcacagcaagtttgataaacacacatttcctccttttatcagtgagattgcaaaatgtgaagtatgagtttccagttttactgattcccctcaacccttttcctgtttaaaaacttagacatactaattggatgctgatctgtccctgtttttcattctgcttgctggtagttgacggcttagtttagtacttacctaggcaagatttggcaaaccttcaaaaatgaactttccatgtattcaacttaaaggagattcatcccaaggaatgtaatgtgaacactaattaacattaatgactgctaatcactttgctttttatactcctttaggagcactgctattatccaatgtagttaagtaaaatgcttgtatatgaatcaacaatgttgcatccttttagcagctattgctcacaatcaagctttgcataaattaaagttgactaaaattgattttaatatgctgctcttcttcaatagtaaactaaaatatctagttaaatatcctgcatattaaaaatacattgcctgattttttttgtagtcatcctgtggtagatgaaaagcaatattgcaaatacattttctcacagttcatgacactttctcttagatttcttcaaaattgaacacaactcttcatagtcctatcagcactttgattctgttgtaagcattaattttgttagatcaatgaaaagcaatcagcctatgtttaatttttctgaatttgttcatttacttcctagaggatcttacagattctttagatgatatagtctatttatataaagttggttcataggattgtacattcaacattcattaaaaaaggttgtttattatgtttagtgaattacaggaccattataaaagctttctgtttatttacatgcattcaatgtacctgtgactagaactgccttgccttaggaggaaactaagcaaaacccataaattaataatttaagggagcaatactcaagtagcatttcagttaaaaagtaaagcctcagagtcagtactagccactttagcattgctttactttttgacttttattggctgaaaataacttgttaaactggagcttttgtaataaaatgaaatctacataccatctaaagccccttcccctccttttgatttatgagtaggttgacatattactggagaatttgtaacactttcacagttctgcactttgatttcagagaaggtgctaatctctctggaattttgagagtgacaaaatgagttgtatactgtttttccagggaatttgggttcctttattagaggccttagttttattatggtacctgtattaatgtggatttatccaatatgtgatatggtggtatgattagatatacattaatggaggatttttttttcattgtacatattctacttggtttgatcatattataattctcacagctaatgtccatgtttctacagaggttcagcaattcaggatattattttcaaattaccaaaatgagataatttaactcccttttacttttgcattatttttagtggaaaaaaattaaatggtagtattataagaagctttatgctgtgtatgctagtcttattgtatatatgtactgaaagtacctttgacactgtacttaattggatttaatttcaaagaattgtaacaggaattatgtgagagaatagaaaatatatggaacttaattaagtgctgtccatatgtaaaggtaagattcatgactattgtttgatgtaacttatttattttacatcctgatactgttgtataatagcacaaaatgcatgtctatgaggaaaaacttgctttttctattttactttgagtttttatgtgtaataaaattatgcttaaaataggcgaggatttcagttttgattcttcttcttttgttttttttttgtttttttttgtagcatgtttactttcacgtgagagtgattgatctgtagctgtcattttatccaagaagggacaaatggaattggtcttttagacaaaagtatgcaaacagactgcattctttctgttgatagaattatggaagaattgcatgaggtgccacattcagttgcctattgattgtaaagaggattctgcagtggggtgctgtttccaatggataaggaggtgctatgattacttacctttctcatgaaagcactacaaagggaaatgcaaaatgtgtgcagtgcagtcttctctatttgacagttgtttttgttaagttttttcccccattgaagtccagcctgttttagaaaaacatacattttagttctttcccctttatatcaggcttagtagatttccatgcatttgaccctttagagaaattacatgttatagacagttttctttttctcagcctctattgtaaagcttcaaagctgatgcaacagtgccctctatagtcttttagtgaacattagacagatgtagatgatttcaaatgttcaggtaagaaacaggacatttaaatttaatttttgttcaaacaagagacccctttttcctaagtagacattcttgtttttcactagtggctttactttaaacaaagagaacaaaagaccattctgagttttcatttagaattattggctgcttcttctttttatcccttggtaaatctcaagttttatcagacgttcatcagagtaatttgagaaagatggaatcttacaggctgtactgtctgttcatgaaatatctttttgaagttgaactctgataggagtattttttaaaaataatttagttcctttgtacttgttttttctatttaattagaatctgagtgggctgcctaaaatttgacttctatttattcctgaattgtgaaacccagtcgttatacatgacattatttaaattcaaaccaagggagttacacaatgactaaagtgtttgtcattcattagcattgatttaaattttagatttcctttttctctttttggttacctttttgattgtatatattgatagctaagtttttcattgtaaaatgcaactagatgtgaagttatggataataaaagcaggaatcatatttagatatgattagaagagaaaaatgttatggattaagtttattttgcttctgaaagtgttttaataaaaagatcacgggccc

SEQ ID NO: 127084 - DNA, 581 bp, Homo sapiens
  Payload ID: 4898
  Gene Symbol: DPH6
  Gene Name: diphthamine biosynthesis 6
  ENST ID: ENST00000561411
  CDS Start-End: 74-581
gcacgcacgcgcactgcgcccagcatgagggtcgcggctctgatcagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaaga

SEQ ID NO: 127085 - DNA, 465 bp, Homo sapiens
  Payload ID: 4898
  Gene Symbol: DPH6
  Gene Name: diphthamine biosynthesis 6
  ENST ID: ENST00000558266
  CDS Start-End: 1-465
cgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaagtgcctgacaactacagaacatctaattatatatataatttttgaaaagtgttttggaacattgttcattaaaccaccatttctatac

SEQ ID NO: 127086 - DNA, 3424 bp, Homo sapiens
  Payload ID: 4899
  Gene Symbol: DIRAS1
  Gene Name: DIRAS family, GTP-binding RAS-like 1
  Uniprot ID: O95057
  ENST ID: ENST00000323469
  CDS Start-End: 185-781
ggggacggcgcgggcgcgactgcggcggctcgggcgggcggggggcggcggcgccagcggacaccggagcgggcaggagcagcggccgcggcgccgcagggaccagcgggcccaggctcggtctggggttcttgcagctggcaccagccctcccggccccggccgcccacccgccgcggggaagatgccggaacagagtaacgattaccgcgtggtggtgttcggggcgggcggcgtgggcaagagctcgctggtgctgcgcttcgtgaagggcacgttccgcgacacctacatccccaccatcgaggacacctaccggcaggtgatcagctgcgacaagagcgtgtgcacgctgcagatcacagacaccaccggcagccaccagttcccggccatgcagcgcctgtccatctccaagggccacgccttcatcctggtgttctccgtcaccagcaagcagtcgctggaggagctggggcccatctacaagctcatcgtgcagatcaagggcagcgtggaggacatccccgtgatgctcgtgggcaacaagtgcgatgagacgcagcgggaggtggacacgcgcgaggcgcaggcggtggcccaggagtggaagtgcgctttcatggagacctcggccaagatgaactacaacgtcaaggagctcttccaggagctgctgacgctggagacgcgccggaacatgagcctcaacatcgacggcaagcgctccgggaagcagaagaggacagaccgcgtcaagggcaaatgcaccctcatgtgagcccggaacgcccgcctgcccgccgcccacccccactgacccccgctgcctcccccaacaccgacaccctcctcggcctcctcctcttctctcatccttcctccgacacctcggctggggaaaccgaggccaccgcccccccctccgctgcccctgcccaccccgaggcagggctggggcttttcttcctcccctgctctctctccaccctcctgttctgtctgtaccctccaaaaccaagagccggaggtggcccccttgtcctgcagatgggaaaacaggatggggagctggcaagaggagctgcttgttcccaccaggaccagaggaggctgcgtttccccgtttccatctctttccctggggtgtccccagccagacctgcgcgtcctgtccctcacatttgatcactgtgaccttctgggggaggggggagttgaaaatgcacatcggcctcagatatttttttcttttttctcctatttggtgttaacatacacccaagcccacccggcccgtcgtgacctctgatctgtgcccactcctccggttccagacgcacctctctcctctgtcttcacagtggggtgtggggcccgtgggatgggcctcaggccaccaggcaataaccacagggcctgcagcagtgcccctgccagccccgaatcccacccccgggaccagccacatccacagcacaactgccccgctggagaggcaccatgggcgtggaggggcttcccggacaccgcccacccgggacccgcctcttccaccaagacagagacgttagcaacgcatggcgggtggggacctggggtgctcaggagggggtacccggggccccggccagagatacatcaattacacccccgtggggggacagccgatgggagccagcaccagcaggatccgagggcgccccggacagaggtctgccccacccacttcctccccaccacctgtgccccagagagcagggcctgcccgggaaggtggcgtcctggagtcgagtgtacctgcagccatgaggttctgggtgttttttgagagagtctgagtgacaccacactcgtgtgaccccacagggttgtgtccaacatacacggaagtggctatggaatggtgtatttgtgcaacctggggtgcgcggatgggtgacttgtatctaagtgcatctgcgtgtatacctgtgtgtgtctgtctgggatgatatgtttttgtggcagtctgtgtgtgtaatagtggtgtagggtatacagagaggtgggtagttgtagatacctgtgtgtggttgtcagcaagactggatatgtgtgaggtgtctgtgtgaatctttgtgcctgtatgagcatgactatattttggggagtgggtgatatggtttatctgagagcatttatctgtaaatatgtttgtcctgattgagggacacgatctgtgttccactctatagcaacatgactctagcaatgtgactttcggttccaaatctgtatcagtcagctactgctgtgtaacaaatgaccacaaatgtagcaaccagaaacaacacatgcttattatctcatagattctgtgggtcaagagcctgggtgcaggttggctgggtcctctacttgggatctcaggaggctgcaatcaaagcattcgccaggcagaggtctcatctgaaggcctgatcggggaaggatttgcttcttagaagctcatgtggttgttgcagcattcagttccttgctgttgcaagactgaaggcctcagttcctcgctggctgttggctggaagctgccctttgttctgtaccatgtgggtctctccacagcggggctcggagcatggcagctaagttagtgagggaaggtgagatggaggttttggtcttattgggtgtgaggaagcaacgtgtgtgtgtgcgcacgcccttttgtgcagtgagagagagagagagattgcacacatgtgtctctgtagtcatgtggccaggtgggactatgtaggtaacagattgctcgtgtctgatttggtacaagcatgtttgttttcctctgtgttcgtgtgagtgtttactcaacaaatgtttattggacacactcagagagagggagtgtgcacacgtgcgtgtgtgttgctatccagcacgtggaccgggctcccagaagagctggcattgtgtctgagcagagctgggtccccccaaaacttgggctggcccagggcccaccagcagctgatgttgcctcctctcctgtcctggcagtagcttctgggttctgaaggtgccggagagagtgaggctgggcaggggtctgcggccctttctcagggacacaccctgatagcacaatctccttggggccctgcccacctccaggcctctcccacctcaggccctgcccgaccctggggagagagggcatctgcaataggaggggacccgagcctgtcctggctgctggcccatcctgcctgggcatccctggtgctggggactgtgccaggccatgcttgctgtgactccgcccctgccccctctccccccgcatgtgggtgcccccactcccccatcgtggggtctgtgtagccttcgctctagacatagtcttcctgcaataaaaaagtggatcctgcattccccacca

SEQ ID NO: 127087 - DNA, 546 bp, Homo sapiens
  Payload ID: 4899
  Gene Symbol: DIRAS1
  Gene Name: DIRAS family, GTP-binding RAS-like 1
  ENST ID: ENST00000588128
  CDS Start-End: 139-546
agcagcggccgcggcgccgcagggaccagcgggcccagattcccagcctcaggatcccatttatggcaggctcggtctggggttcttgcagctggcaccagccctcccggccccggccgcccacccgccgcggggaagatgccggaacagagtaacgattaccgcgtggtggtgttcggggcgggcggcgtgggcaagagctcgctggtgctgcgcttcgtgaagggcacgttccgcgacacctacatccccaccatcgaggacacctaccggcaggtgatcagctgcgacaagagcgtgtgcacgctgcagatcacagacaccaccggcagccaccagttcccggccatgcagcgcctgtccatctccaagggccacgccttcatcctggtgttctccgtcaccagcaagcagtcgctggaggagctggggcccatctacaagctcatcgtgcagatcaagggcagcgtggaggacatccccgtgatgctcgtgggcaacaagtgcgatgagacgcagcgggaggtggacacgcgcgaggcgcag

SEQ ID NO: 127088 - DNA, 774 bp, Homo sapiens
  Payload ID: 4899
  Gene Symbol: DIRAS1
  Gene Name: DIRAS family, GTP-binding RAS-like 1
  Uniprot ID: O95057
  ENST ID: ENST00000585334
  CDS Start-End: 100-696
ctttgacgtgtgaccctcctctctgcacaggctcggtctggggttcttgcagctggcaccagccctcccggccccggccgcccacccgccgcggggaagatgccggaacagagtaacgattaccgcgtggtggtgttcggggcgggcggcgtgggcaagagctcgctggtgctgcgcttcgtgaagggcacgttccgcgacacctacatccccaccatcgaggacacctaccggcaggtgatcagctgcgacaagagcgtgtgcacgctgcagatcacagacaccaccggcagccaccagttcccggccatgcagcgcctgtccatctccaagggccacgccttcatcctggtgttctccgtcaccagcaagcagtcgctggaggagctggggcccatctacaagctcatcgtgcagatcaagggcagcgtggaggacatccccgtgatgctcgtgggcaacaagtgcgatgagacgcagcgggaggtggacacgcgcgaggcgcaggcggtggcccaggagtggaagtgcgctttcatggagacctcggccaagatgaactacaacgtcaaggagctcttccaggagctgctgacgctggagacgcgccggaacatgagcctcaacatcgacggcaagcgctccgggaagcagaagaggacagaccgcgtcaagggcaaatgcaccctcatgtgagcccggaacgcccgcctgcccgccgcccacccccactgacccccgctgcctcccccaacaccgacaccctcctcggcc

SEQ ID NO: 127089 - DNA, 4385 bp, Homo sapiens
  Payload ID: 4900
  Gene Symbol: DIRAS2
  Gene Name: DIRAS family, GTP-binding RAS-like 2
  Uniprot ID: Q96HU8
  ENST ID: ENST00000375765
  CDS Start-End: 390-989
tttaagcaggagcagcagcctctgcagcagttggcacatctgagaaggcagagattgaagagagtaggaggagcgtgcagcggcggtgacagtgccaggccggagcggctcaggccagcgcaggtgcaggggctgcgagcgggtggagcgcgagggcgctgggcgcagggagcacggccggtgggcggtgcagggcgcacggcgggcgagcagctgacagcatcgtcacggcggcgggagggagtgcgctgcgcctgcctccgggaggagccgcatccacacaccctgcgctgccctgtcctgcgcgagtggagctctgaagaagctctgagcggagttgtgttcttccccaggtgcgtcctggctgagagttggagctctccagcaacatgcctgagcagagtaacgattaccgggtggccgtgtttggggctggcggtgttggcaagagctccctggtgttgaggtttgtgaaaggcacattccgggagagctacatcccgacggtggaagacacctaccggcaagtgatcagctgtgacaagagcatatgcacattgcagatcaccgacacgacggggagccaccagttcccggccatgcagcggctgtccatctccaaagggcacgccttcatcctggtgtactccattaccagccgacagtccttggaggagctcaagcccatctacgaacaaatctgcgagatcaaaggggacgtggagagcatccccatcatgctggtggggaacaagtgtgatgagagccccagccgcgaggtgcagagcagcgaggcggaggccttggcccgcacatggaagtgtgccttcatggagacctcagccaagctcaaccataacgtgaaggagcttttccaggagctgctcaacctggagaagcgcaggaccgtgagtctccagatcgacgggaaaaagagcaagcagcagaaaaggaaagagaagctcaaaggcaagtgcgtgatcatgtgaaggcccttcctgcgggaggagcagctgtgtgtccccggcacctcactcccccaaaatgacacccaccgtcgtcagggtagcatgtataatgcccacgtgttaaacattgcatttaatcgagatgcgtcctattgtccttaagagggcgtttcacaccaccaacagtaagccacccactctggagtcacagaatctgccaggcggttcaagtgaaaaccaacacactcagcatccctgggaactgagaggtgccagcaattgctgaaggtggcgatgaacacccgaaggtgggagggaggactggtacccacaaagcaacatgtaccgagaggactaaatgtcatctacgtgcatgtgagagcgtgttaacctagagttacctgcaccaaccccagacagaagccaatcacatctttgggggaggggaggggcaggaagaggtgagaagatcagatggtccaaagtggaccacacttggtccattttacacttttttaaaggggattaaaaaacacagcctctcccccaaagggtgtccgttcttaattcccacctggcctgttaggagccttgctaccctgaggggatgtgttcaccttacctagacctagttaggaagtatcattttaagctattagagtatttatcttcatgtgcagggataagtgcactaacagtgtgctgctctgtcggaagttcttcagtttttaagtgaggatatcgtgacagtattaaaacatcgcaataatgttcctgtgtgttatacatcgagggttttagaaatgtgattttcttcttttgacctgtgaggagtataacttctttcagccctcagattttaaatacaagcaaataaactcactatttttagacgtttttttcctccaaggtggttttcttctcttaaataactcgatctgtacccagctgggtagcagccagcaaaggccatcagacaaccagaagcacatccatttttgtagtgtcacaaacatgtatatgccacactttgcaccttaatgaaatactttgaaacagaagttattcactgtgtttttgatgatctatctgtattggaaatatgttcctggaaaatgcatttaaataatagtaaattctcttgcatgttccattatacgtgtcttctaagagctgttcaatacagtattcactctagaaacaattatctttttctcttaatgattttgtgtgcatctttaatctttcaagccaaattacagctatttcaggtttcctgtgttagcttggggataggatggtggctggagacaggcaggcttctctgccctgggaagagcccactcagcttaattgctctgccatcgtagagcctggttggacttggcttcctgaaaactcccactgatagtgcctgttagatctcctgtttgtttcagttggcagaacatttactggccccaactgtggcatcatcctctcagcagtcttcctgtcacccgcctggcaggcagaaggagctgcagtcccacgtgggcctgcctgggggggtgggggctgcatggctgttgggtggcagtgtcagcacagggagggcttaagttggggatgtttgaccaggccacctcctgcaactgctgtttctcctgtccctcctatgcagggcttgcagcagcagcagtgtggccatctccatcccccaaagcacacttgctctctcaatatgtcctagttttcttcagccttttctggttcagttcccttgtcctgatctcatcctctctggtctcccaataactcacccttgggatgtgtttagagcgtgggaggtgcctttgagaactgcttgactccatgatctcctagaacaaaaccgccctgactttacagggggaacactcatgctgagctgagaaagcagagaagtggcgtgggagccagctgggggtgaagagcatttgggccagtcccgtggcccccttcagattcctcaagcaggattgttctgttctaaaaagctgttgcacagcattcgcaatgagatctttagttggcggattttctggaacatttgtttttcaacttgtcccgacattttttttctgtttctattctgagagagagatgatcaagttttaatttgggtataggttaaatggaagaagaaacagaacttcatggccaaagtagacctatagattttgattgggttctttgttaacagtagaatgcgatctttgccactgactgtagtattaataaggttttaatgtgagatattcctgcaaaccatcccatttctactgattgtaagtcagaatttcttttatccctttcaaatcagtttctacatgtttaagtgttcagggcttcatcagcatgagaagtttgtaattactgaaagtctgatttcattcaggacacattttttccttcatattttttctgtgaatttataggctaggaaggctattgaagcctcaattatgggtcttcattttgagatcgttttctatgagctgaactgaggatatcaatggttatctcaaaatcgtcttttaggagatccccaattgactcagagtttgaggagttagtatcacagaattagatttttttaaagcatttgtacgtttccattcccaaatatgtagctgtggttcttgaaaacacatcctacattgcatatgggcatagcagtttttgacccaggcagaataagttaatatttaattaaatattgctttgaagatggcgctctgggcatgagcatggggctccatgacttcccttctatccccatgagcccctcctccatccagcgacaagccatgggcatgcatacaatgcagcaagaccaacacaagagcaatattgaattgttcattctatctaaaattacatgtatataaaatatataatttatcttcctgcatttttgaagtataaagtcataaattgtacatatctgtaagctagtatatttgtttcactgtttgtaatatttaagaaatgctcattctttgtagaacaaaaatgtattaaatattttaaaaattgctctgtgatacttaatttttttccccaaaatttgtaatgtgttgcttctacataagttctctggaaatatctacaactaataggacacatgtaaatccttgaagacacatcctggaattcataccccacaaggacagtgtgtatacaaagtatttgcagagcatgacttttatatgtgtgggatatcaatgtgtatatttatatttaaagtgtatttattgttacaagtctattctctattatattttatttactctgcggttataaaaatcacccttgcatacaagtttctagttgccagtgatgttctggaaataatgggagatattacaataaagctacagttatgacaccctg

SEQ ID NO: 127090 - DNA, 1973 bp, Homo sapiens
  Payload ID: 4901
  Gene Symbol: DIRAS3
  Gene Name: DIRAS family, GTP-binding RAS-like 3
  Uniprot ID: O95661
  ENST ID: ENST00000370981
  CDS Start-End: 638-1327
acacaatcgggcttcctagccgctggcggacccgatggggcgtcctgcgagggttcggcgagggttctgccaggatagtagcattgcgcccaaggagtgagaggcacccggggctactggagccagaccctcaacccgccctagtgggaggcgaagaacaacgaaagcctcgtattcccatttctctaatggctaatgacattaaagtatcatttgtggaaaagattatctgtcctgcattaaactgcttttggactttcgtctaaaatcagttggaccggtttttgttggcaaagttttgcctgaagcttattccaacagatgccaagcggacctcgcgccgctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaa

SEQ ID NO: 127091 - DNA, 1629 bp, Homo sapiens
  Payload ID: 4901
  Gene Symbol: DIRAS3
  Gene Name: DIRAS family, GTP-binding RAS-like 3
  Uniprot ID: O95661
  ENST ID: ENST00000395201
  CDS Start-End: 296-985
gctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgc

SEQ ID NO: 127092 - DNA, 10604 bp, Homo sapiens
  Payload ID: 4902
  Gene Symbol: DIS3
  Gene Name: DIS3 homolog, exosome endoribonuclease and 3'-5' exoribonuclease
  Uniprot ID: Q9Y2L1
  ENST ID: ENST00000377767
  CDS Start-End: 102-2978
ggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacgtatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagattaattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaattatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcggttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacatcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgcaaaaaaaaaaaaaaaaaaagaaaagaaaattagccaggtgtggtggcaagtgcctttaatcccacctcaggaggctgaggcaggagaatcgcttgaacctgggaggcagaggttgcagtgagccaagatcgcgccactgcactccagcctgggtgacagaacaagactgtctcaaaaaaaaaaaaagagaagaaaaactgcctacaggccatagttaacctgcaatagagaagaaagggaagtagggcagtgcatgactggccttaggttttttctttccaagtttattttcttgtgcttcagctactagaaaggtttaattcagggataagtcccaattgagtagttcaagatgatcagagactttgctattttcccctaagttctattccataatctaaaatgttctgtttctagtgccagttcttatgctaagcaggttacgtggaatatatcacttaactcaaaaagccctgttaagccaggactgttatctccatttaacagatgagaaaatggaggtttatggtctgttctcacactgctacgaagaaataccccaaactgggtaattattataaaggaaagaggtttaatggactcagttccgcattgctggtgaggcctcaggacacttacacaatcatggcagaaaaaggagaagcaggcacctttttcacagggcggcaggatgaaaatgactgccagcagtggaaatgccagacgcttataaaaccttcagatctcatgagaccggctcactatcacaggaacagcatggaggaaaccgcccccatgatccagttacctccacctggtcccacccttgacacgtggggattgctacaattcaaggttagatttgggtgaggacacagagccataccatatcagcccagatcaagtagtgacagagtagggatttgaatacaggttatagtcactattgtgttatttcttgacttttgtactattaaaaaactgtagccagtgaggcttctacccttagtacccagaactccttttaggtatagcaattgtttttaggtaaatttatattgagtttaacacctgtgtgattaaagacaactttccaatgtagtatctgtagccatgtcccctaatggctattagtgttcatggttagtgtgttgaagatgagccaggtacataacgcggcacattttctgcaggtcagcagtaaggtttcaaggtacagttatggaggaaagaagaaaatgacacattgataacacaggtctttattcccttttgaatgagacagtttttaaaagttgatttataaatacaaaaatacattctccaaagatagtatttccaaactgttatatacccatctactcccaacatggatataagttttttaaaaaaatagttgtatataacatacatatctgccccagtgttacttcacaggcctatgccctacgggaactccactctcccagccccactttttctcttggttctcccacattcttattctcccacatccctacccacgtttgagctggaaaggatgtccctaccctaggcatgaggtatattttattctgggcaccacacatttgccccatagataacaatacacgtgatgatgtcactagtactacctttctagtatttacatacttaaaagtagtaactagaacagttatcactggaactaagaattttccccacagaggtgaacagaccaagaactaaaatttcaggaaacctgtttaatttcttttgtatctttgaaaagttagttttatatctaagatttcttcacataggttataattcatctgtatgttcaagcttttatgtaaaaatatatagtgccttcagttttaacatagtttcacatgttctcagaactgctaaattcagtgctaccagtaaggcttaataagtagttcattgaccctgtaagataggagcactcagctctgtcacaatttgttgttaaacacatcactcaatgtaagtataaaaatatttattgataaaaaataaacttataattcagcaacttgaagttccaggagcatttctgttgttcctatgtcagtaagcccttgatttttcacattaaggagggaaagctaagcatgttacttgaagtaattttttcccagtcaccatcatgttgatcctgtgcacaacgatatatgcgaggaactcttaagcttagtctttgattctgacagaggcattctatggactgctgcattgaaaagggcttgctgttttcatccaacacctctgtgttgtgtggtcttgctgtgaaaaagaagacaataccttgttttcagtttaagtaggaccactggaggatgcaattatcgggactgtttttaaaacctaaaagcacgtttctttagctgaactctgaagggacagtaaagatacagtattttataaatcaatattctgcatcaaaaagcatcccaacactttgagaggccaaggtgggaggatcgcacgagcccaggagtttgggactagccctggcaacatagtgagaccctgtctctaccaaaaattttaaaaagctgggtgtggtggcacatgcctgtagccctagctactcaggaggctgaggtggtaagactgcttgagtctgggaggtgaaggctacagtgagctgtggtcgtgccactacactctagcctgggtgacagaatgagaccttgtctcaaaaaaaataaaataataaaatttaaaaaaatccttcatttatctctacttatgtttagatagacaactgcatcctgaaataggatggattttgttcaggttaatattagaagagacctgctctgatactacatacaacagaaaggcagtttgctcctactacatacaacagaaaggaaaactaaggtggcctccctattaaacatttgttgcacatttgctgatatttatagtattttataagaaactggcatataacagcagggcaaggtggttcacacctgtagttctagctactcaggagggtgaggcaggaggattgcttgagcccagcagttaaaggctgtagtgatctgattctacgactgcactccagcccgggtgacagagtaagaccctgtctcaaaaaaaaaaaaaaagaaaaaaaagaaacggcatacaaggctgggcatgttggctcatgcctgtaatcgcgcagcactttgcgaggctgaggcagaaagactgcttgacaccaggagtttgagaccagcctgggcaacacagcaggccctgtctctacaaaaaaataaaatgcaaaaaaaattggcacataaaattaaagactgtcctgactagtgcctgaaattatgatgagtttcttcaagtatgaatatataaccaccacctggaaggttcagtaaatgccctcatcaaatacacgctacctttgcacactttgtagtatgtaagatacttgtgtattcagagtaaccaaaatatttaaaggttattggatgttaagaaaacaggcttaccttttagtgttttaaatttcatatagtttctcaatagtactattgtctaataatcaaaattattttatatttctaatctaaacaatattaagctttcactatattttctccgtaccttcatattaaatgcttgagatttactctcaacttcacatgtttgtgcatcactttctttgcagtaactttctgccccaactgtatccataatattgcttccacaattctgcgtattatagccactatccatctgacaggagaaaaaagaaaaaaatatattgtgaggaacttaaaagtcaaatatttaaataagtaaaccactataaactctcattcactacatctgaatgatcctaacatgtaatattgatcatgttgaacaaaattcaaaagtaatgcacaaatataaaaggtagtcctgcatagtactgattattgtagtcattttacaattccttccaatgaaatatatcttgtaacttccttaagaatcagtgaacagcctactgacacaatgctttcctgttattttgtgatcgtacctagtagacaaaaatgagtattacaactaacttcaccttccaacgcattttccaggcttgtctctaaatggcttgaggcatgctgcctttaaaaaagtggattatattatatttacacctagttgttcacaataatgccacatatataatggctctagatgttagttcagcttttcatgttaataaaaattgtagcatcctaagatacactgtttcagtgcaaaagagcaaaaaagaaagattctagcgaacttccagcttggaaacatttattgagtgtctaaaaaggccaggcactatctctatatatttaatatttttttctcctttcaacaaccctaatactttactagagaaggaaattaaggcttaaaaagcttaactttcacaatgtcatccagtgatgaggtgatgaagatgtgagacctaagtccaggttctgttcactgcacaacgctccatttacctgtataatgctgagcaccaaagaaagcaatccacaagggaatcattttgcatttaagccctccctgcaagttaggatcagagggaaggaaaaagctgactgtcattttgtttccctcacaaaggtacagactagcctagaaacggcactctttatcacttaataatcctgaaaaaatgttcccagatttcaaggctggatacatatctgcttactactagaggtcatgttccaattagaacaaaagccttgtgatgtgtaacatttttggggaaaagccttgttctgctatcattcaatagctacttgatcaaaaatataaatgtcagattgctcccagagattctgccaatagctcttccttctaatattcatcactgccaaatagctggcttataatgcaatactaatatgtaactggatatatatggagggaagagttactcattagtacagcaggaagtaaggcatgcggggagtttgtcccacactatgggaagagcaggattgatgagagccaagttgagatggtggctgacttcactgtctctcatctagacttctgctaatgtcaatgcctaatatgtaccaaccaggcaacagataccttgttatcccccacaggcatcaaggcaggcatcaatctcactttatagctaagaaggatgaggggacaaaaattaaaaagtcatgttctattcactgctatgtaaatcttgccttaagatcccacagcctggaaataaaagaactctaattcaaa

SEQ ID NO: 127093 - DNA, 5232 bp, Homo sapiens
  Payload ID: 4902
  Gene Symbol: DIS3
  Gene Name: DIS3 homolog, exosome endoribonuclease and 3'-5' exoribonuclease
  Uniprot ID: Q9Y2L1
  ENST ID: ENST00000377780
  CDS Start-End: 94-2880
aagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgtaagtgcctggaggccggggacctgggcttctgtggcctccagcctgcgactcccaggcagcttagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacgtatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaagtactttgattatttaatatttgtaagaaaaaactttcattttcctacagaggaaaatagaacaattttagaagcaaggaacaatctcttttctaagtcttggaagctgtcagtgttgaggatgtaatctcctttgccatctttaattcacctaacttacactaggtgttctcttactgtctttaaaagcttcctgtattttattagtggtccttgaaaaactgtgaatgtttgggaattggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagattaattagtggcttttaaattgtagttatatcagtgtatatacacgaggggaactgtataaagacatactaaagggaacagattaaaataagtattattaataaaatttggtgtgccagactgactacttcccttgctaatcacagagattagtaatgattaaattaatatcttcaggaatattttgggatagggttgccttaaaacattttacttggcttattcaatttctaaagcacttacgttgtgccaggttccactcaagtaaattatctctgccttcaaggagcttgcagtatagtgagaaaagcctgccaagtaaatcagcaggtatactaaataggtagtcatttaggcactcaataaatgttgactaatttttccagtttcctattactgaggaaaacctccatacactgaggcagaaacttgtgtcagttggaggaaaatagacttgagtagtctttggtccaggtaaaatgggtcagtgacactgaaacagtagagtaggagtcaaaaaaccttttctgtgaagtgctagaacattttagactttgttggctatggtctgtattgcaactatagtacacaactctgccgttgatagtgtgtaaggagccatatacaatatgtaaacaaatcaacatgactgtgtttcaacaaggcctgatttgttaagtttcatatatagtcatatgtcacttaatgacagggatatgttctgagacatgtcacttggcaatttcatcattgtgtgaaaatcatgatgtagttacacaaacctagatggtataccctatggtatcctatatgggatagcctattgctcctaacctacaaacctgtatggcatattactgtactgattactgtaggcggttgtaacacagtgctaagtatttgtgtatctaaacatatctaaacatagaaaaggtacagtaaaaatatatatatagatatatataagatataaaatggtacacctatttaggacatttaccatgaacaagttggcaggactggaagctggctctgggtgagtcagtaagtggttagtgaatgtgaaggccatgatattactgtgcactactgtagacttttataaacactatatacttaggctacataaagtaatttcactatgatgttaccatggctgtgtccccaggcaataggaatttttcagctccattgtaatcttacgggatcatcatcgtatatttggccattgttgaccaaaagttatgcagcacatcattataattttgatgtgtcacaaaacattactcatttgatttcccccacccccgccaaccatttaaaaaagtttgccggctaggtgcggtggctcatgcctgtaatcctagcattttgggaggacgaggcgggtggatcactcgatgtcaggagtttgagaccagcctggccaacatggtaaaacgccgtctctactaaaaatacaaaaacttagctgggtgtaacggcggatgcctgtaatcccagctacttgggaggctgaggcaggagaatcgcttgaacctgggaggcggaagttgcagtgagccgagattgcaccactgcagttcagcctggatgatgagagtgagactccatcgc

SEQ ID NO: 127094 - DNA, 2934 bp, Homo sapiens
  Payload ID: 4902
  Gene Symbol: DIS3
  Gene Name: DIS3 homolog, exosome endoribonuclease and 3'-5' exoribonuclease
  ENST ID: ENST00000490646
  CDS Start-End: 23-1702
ggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggcatctctgacgtatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataattt

SEQ ID NO: 127095 - DNA, 3651 bp, Homo sapiens
  Payload ID: 4902
  Gene Symbol: DIS3
  Gene Name: DIS3 homolog, exosome endoribonuclease and 3'-5' exoribonuclease
  ENST ID: ENST00000545453
  CDS Start-End: 819-3209
gtgaggtggcgtccagaaggaagccccgcctaggccacgggcggaaatggctcctcgccttgctttgccgcccctccccactctcgcccaatccccgcggccgtcagagagccaaccaatgtttatctcggcattttcccgcgagaagtgttactaatatccgggaatggaaagggaagaacctccggggttaggcgtattctagattgacgccttttgctggaagagcgctgctggggttaggattctgcgcggcgaggcaagatgctcaagtccaagacgttcttaaaaaagacccgggcgggcggcgtgatgaagatcgtgcgcgagcactacctgcgagacgacatcggctgcggtgcgcccgggtgcgcagcgtgtggaggggcgcacgaggggccggccctggagccgcagccccaggacccggcgagcagcgtctgcccgcaaccgcactacttgctgcccgacactaatgtgttactgcaccagattgtaagtgcctggaggccggggacctgggcttctgtggcctccagcctgcgactcccaggcagcttattgatgttcttgaggaccctgccatcaggaatgtaattgtgctacaaacagttcttcaagaagtgagaaatcgcagtgcccccgtatataaacgcatccgagatgtgactaataaccaagagaagcatttctatactttcactaatgagcaccatagagaaacctatgtagaacaagaacagggagaaaatgctaatgacaggaatgatagagcgattcgagtagcagcaaaatggtacaatgaacatttgaaaaaaatgtcagcagacaaccagctgcaagttatcttcataacaaatgacaggagaaacaaagagaaagccatagaagaaggaataccagctttcacttgtgaagaatatgtaaagagcctaactgctaaccccgaactcatagatcgtcttgcttgtttgtctgaagaagggaatgaaatagaaagtggaaaaataatattttcagagcatcttcccttaagtaagctacagcaaggcataaaatctggtacataccttcaaggaacatttagagctagcagggaaaattacttggaagctacagtatggattcatggcgacaatgaagaaaataaagagataatcttacagggacttaaacatttaaacagagctgttcacgaagatattgtggctgtggagcttctccccaagagtcagtgggtagcaccatcttctgtggttttacatgatgaaggtcaaaatgaagaagatgtggagaaagaagaagagacagaacgaatgcttaagactgctgtaagcgagaaaatgttgaagcctacaggtagagttgtaggaataataaaaaggaattggagaccatattgtggcatgctttccaagtctgacattaaggagtcaagaagacatctctttacacctgctgataagagaatccctcgaattcgcatagaaaccagacaggcttccacattagaaggacggagaattattgttgctattgatggttggcccagaaattccagatatccaaatggacactttgtgagaaatttaggtgatgttggagagaaagagactgaaacagaagttttgttacttgaacacgatgttccccatcagcctttttcacaggctgttcttagttttctgccaaagatgccctggagcattactgaaaaggacatgaaaaaccgagaagacctgaggcatctgtgtatttgtagtgtagacccaccaggatgtactgatatagacgatgctctacattgtcgagaactcgaaaatggaaatttggaggttggtgttcatattgctgatgtgagccattttattaggccaggaaatgccttggatcaagaatcagccagaagaggaacaactgtgtatctttgtgaaaagaggattgacatggttccagagttgcttagctctaacttgtgttccttaaaatgtgacgtggacaggctggcattttcatgtatttgggaaatgaatcacaatgctgaaatcttaaaaacgaagtttaccaaaagtgttattaattcaaaggcatctctgacgtatgctgaagctcagttgagaattgattcagcaaacatgaatgatgatattaccactagtctccgtggactgaataaactagccaaaattctgaagaaaagaaggattgaaaaaggggctttgactctatcctctcctgaagttcgattccacatggacagtgaaactcacgatcctatagatctgcagaccaaggaacttagggaaacaaattccatggttgaagaatttatgttacttgccaatatttctgttgcaaaaaaaattcatgaggaattttctgaacatgctctgcttcgaaaacatcctgctccacctccatcaaattatgaaattcttgttaaggcagccaggtcaaggaatttggaaattaagactgatacagccaagtctttggctgagtctttggatcaggccgaatctcctacttttccatatctaaacactctgttgagaatattagccactcgctgtatgatgcaagctgtgtacttctgttctggaatggataatgattttcatcactatggcttagcgtctccaatatacacacattttacttcacccattagaagatacgcagatgtcattgttcatcggcttttggctgtggctattggggctgactgtacttatccagagttgacagacaaacacaagcttgcagatatatgtaaaaatctaaatttccggcacaaaatggctcaatatgcccaacgtgcatcagtggcttttcatacccagttattcttcaaaagcaaaggaatagtaagtgaagaagcctatattttatttgtaagaaagaatgccattgtggtattaattccaaagtatggtttagaagggacagtcttttttgaagaaaaggacaaaccaaacccacagcttatttatgatgatgagataccctcacttaaaatagaagatacagtgttccatgtatttgataaagttaaagtgaaaatcatgttagactcatctaatcttcaacatcagaagatccgaatgtccctggtagaaccacagataccaggaataagcattcctactgatacttcaaacatggaccttaatggaccaaagaaaaagaagatgaagcttggaaaatagctatattcaacaaaaatcttcaaagactggtttcttttttaaaagaaaaaacttgaaagaacacttctaagcctaagtgtgtgatacagtttgttacttttaagtacattttaataatttcagacatctgcatttttattgaacagttgactgtatctgacccatcatactactatacttctgggttgaacagaattatttatgcagaataattcaattgaatatccatcacttaaatacagtgacaggacagcaacttcagggatctgtaaagatcatttaaatggagtgctcatctcattgaggagcagattaattttgcgtaataagtgtgatcattgttgaacttcagctccagtgtctctccagaataagacattggcattcaaatgtctatatcttgttacttacaaaataaaaaacagattaattagtggctttt

SEQ ID NO: 127096 - DNA, 3201 bp, Homo sapiens
  Payload ID: 4903
  Gene Symbol: DIS3L2
  Gene Name: DIS3 like 3'-5' exoribonuclease 2
  Uniprot ID: Q8IYB7
  ENST ID: ENST00000273009
  CDS Start-End: 615-2426
atgcgggggttgtccatctctgtatccccagtgccagcactgcacctcgccccaagcagttgtccaataaatgagcagtgagtaaatgaaagaatgagcaaagccttgtaacaggaaaggggccggcggcgtctgccgtgcaagacctggcccagtggagcagagcctggaggttcaggagccgggtctggaaggctccttccggtggaagaggggcccggagccagccggcgcctggcacaaggcgtctcagaggccgcccactgggagccaaccgttgcagccagttgtccccgcgagcgaggccggagaaggcgcggcggcccctggcctggccatttcgcccttgtcgcagctgaaccgccgactacgagctcctgcaccgcgcacacaccccgcgcgcttcgctctcggcctcgcccggccaccgtcgctctctagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccagcagaacgcagacaaggatggggctgcccatcttcaggcctctcacagcccctctgctgaagatgcagaagcacagccctccacagaggaacgcctgcctgagactcggggcatatgtgacagggatccagacacacgactgtttttccttcagcaacagagccgtgtattggaagcaaagccccaaaacacgataagagtagaggagcagacaacccagttgcagatttgaagaagcatgtggaattccttgtggcggagaaggaaagattatggaaagaaagtaaacaggtaaaggctgaaaaggccagacttctaaaaggtccagtagaaaaggagctggatgtgggtgctgattttgtggaaaagtcagagttacggagctcgcctctgcattcagaaactgctataccctcttcagccttgcagaggtttgcagcagatgccaggaaagccaagtacattccaatacccaatcttttccctcagattttccatctccagagcttccctttatggagctttctgaggatattctgaaaggatttatgagtaactaaaatggaaggccatagaagaagggagaagaggaaataatactaagtcatacagttaatccagcaacaaaaaatgaaaagggaaagccacaggcaagggtaatcctggaaatgcctcgtcatctggtgtactgtaggagaagacgcattgccaggatgtggggaacagtcgctgtgaagcgtgtcacatacctgattcactgacttgagctgatgatgccgacctggcagacactaaactcgtggagggtcagtttctcttgacaccaaccaaatggctgcctgaaagaattttttcaagcaacaattatttttcttatcttcagggttaaaatgtataaaagtatgttatgtataattaatctgttatgtcataagtgatcatgcaaaacctaaatattatggcagcctgaggggctgcttcgtatttgaaacatgctttgtctcagg

SEQ ID NO: 127097 - DNA, 3501 bp, Homo sapiens
  Payload ID: 4903
  Gene Symbol: DIS3L2
  Gene Name: DIS3 like 3'-5' exoribonuclease 2
  Uniprot ID: Q8IYB7
  ENST ID: ENST00000325385
  CDS Start-End: 277-2934
tttcgcccttgtcgcagctgaaccgccgactacgagctcctgcaccgcgcacacaccccgcgcgcttcgctctcggcctcgcccggccaccgtcgctctctagaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgccatctggtgtgtagggcgcctctgggaagcctgggcagcagaatgccccttgcacccagggcaagggacccagttcaggcttcacccctcgctgctgagccgatgtcaacacctggaactttcctgtcagttccaacacgattcagagctggctgcctggcagatgattgatactggagtctcattctgcctgattaaaaatggaattagtatgcaacactg

SEQ ID NO: 127098 - DNA, 3328 bp, Homo sapiens
  Payload ID: 4903
  Gene Symbol: DIS3L2
  Gene Name: DIS3 like 3'-5' exoribonuclease 2
  Uniprot ID: Q8IYB7
  ENST ID: ENST00000390005
  CDS Start-End: 176-2035
agaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgccatctggtgtgtagggcgcctctgggaagcctgggcagcagaatgccccttgcacccagggcaagggacccagttcaggcttcacccctcgctgctgagccgatgtcaacacctggaactttcctgtcagttccaacacgattcagagctggctgcctggcagatgattgatactggagtctcattctgcctgattaaaaatggaattagtatgcaacactga

SEQ ID NO: 127099 - DNA, 2048 bp, Homo sapiens
  Payload ID: 4903
  Gene Symbol: DIS3L2
  Gene Name: DIS3 like 3'-5' exoribonuclease 2
  Uniprot ID: Q8IYB7
  ENST ID: ENST00000409401
  CDS Start-End: 176-925
agaacgccgcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtcattgcctacagattttctccacgtgtccaaatggctttcacctgagctacttgttgaagatctcgtgtgattcagtcaggactgtatttggtcatttaatcagaaaagttagagcagagaatcataaaaagtgaattaaaaaaaaaaaactttaaacatataaatacgaatccatcttcctgcctttggataaggggtcaaggccttttctttgagtgtgggtatgttgattggagttctgtgttatctttcttgcttaaaccacacttgtaatgcagcatttatcactttgagttttggtggagtgagaatttagacagtggagaagcagtatgaatatagactctcttcagatttgtacagtttttgctccaatttttttgttgttaccatgcccatacctaatttaaaaataattttaatgtcttttttagtttttccaaagtattcaatttagttatagaaacaattgtttttatattcctatttcaccattttgcacaattcacttgtattctttaattatagaagctagtgtcattttcagatgtgggatgaaacagctgacttcttttttttttgttttgagacagagtttcactgttgttgcccaggctggagtgcaatggcacgatcttggctcactgcaacctctgcctccctggttcaagcgattcttctgcctcagcctcctgagtagctgggattacaggcgtgtaccaccatgcctggctaattttttgtatttttagtagaaatggggtttcgccaggctggtctcgaactcctgacctcgtgatctgcctgcctcagcctcccaaagtgctgggattacaggtgtgagccaacatgctcgactaaacacagctgacttctagctgtgcacatagctcatagtggcagaaatggtgaagggcaacgtataaagtggcataatggcatgaggctttatgtttcagaagcatccatcagtgtgtttcatatgggaatgcagtgtgcttactctaccaagcaagttgattaatagagtattgctcttgcatactgacatgaggaatttctaaattatactctatatatttgagtactaactgtgctccaggcagcatgctaagtgtgggagattagaatgaatggaaagcctggggatggatctggctcacagacc

SEQ ID NO: 127100 - DNA, 2658 bp, Homo sapiens
  Payload ID: 4903
  Gene Symbol: DIS3L2
  Gene Name: DIS3 like 3'-5' exoribonuclease 2
  Uniprot ID: Q8IYB7
  ENST ID: ENST00000409307
  CDS Start-End: 1-2658
atgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctga

SEQ ID NO: 127101 - DNA, 3250 bp, Homo sapiens
  Payload ID: 4903
  Gene Symbol: DIS3L2
  Gene Name: DIS3 like 3'-5' exoribonuclease 2
  Uniprot ID: Q8IYB7
  ENST ID: ENST00000445090
  CDS Start-End: 168-917
gcgcccgtgacccggaagagcattctccttagcaactgcgggactgcggcggcgccggcctccggggagaaacgcgaatgacaacagagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggaagagaggatggtgatgcaccggttacaaaagatgagaccacctgcatttcacaagacacaagagctttatcggagaaatccctgcaaagatcagcaaaggtcattgcctacagattttctccacgtgtccaaatggctttcacctgagctacttgttgaagatctcgtgtgattcagtcaggactgtatttggtcatttaatcagaaaagttagagcagagaatcataaaaagtgaattaaaaaaaaaaaactttaaacatataaatacgaatccatcttcctgcctttggataaggggtcaaggccttttctttgagtgtgggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaacaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggtcagaacccctctgtgtcccagccccctaagtcctgatgacccctctcctgcctcctgcggtgcccctcattccttcatctgtgtcccctgggctcccccagcactgcagcctcccgggtggggttttagggccctcccagctcacccagaccccctcctgtgggtcctgctttctggcaccaccttcccttccttgggggcaaccacagtggagagaggaggggctctgcctgtcccgctaatgcaggggtgctggccttctagggtcctttagagaacctgatgaaagctatgagtttacacccaagaaattgtctggaaccgttttcaccaacagtgtgccctgaacgcggacccaggccctcaggttgtgtttcataagccttgggagcgctcaggatgcatctgactccccaactctgccctgacccagggcattcttcctggagggggcccccattacagacaggcgagcagaggcttccagaggccgaaggaggggccaggggtcctgctgcagggatggaggcagagctgcgcctcgacatcaggccctgccatccttgtcccctcacggctgggctctgcacaggtcatcaccatcttcagcctggtggaggtggtcctgcaggcagagtccacagccctcaagtacagcgccatcctgaagcggccaggc

SEQ ID NO: 127102 - DNA, 570 bp, Homo sapiens
  Payload ID: 4903
  Gene Symbol: DIS3L2
  Gene Name: DIS3 like 3'-5' exoribonuclease 2
  ENST ID: ENST00000441279
  CDS Start-End: 139-570
agagcattctccttagcaactgcgggactgcggcggcgccggcctccggggagaaacgagctgctcaaggcgggaactctgagctaagcagtggaggtttctctggatctggagagaagagtgaccttggagccaataatgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggag

SEQ ID NO: 127103 - DNA, 4671 bp, Homo sapiens
  Payload ID: 4903
  Gene Symbol: DIS3L2
  Gene Name: DIS3 like 3'-5' exoribonuclease 2
  Uniprot ID: Q8IYB7
  ENST ID: ENST00000433430
  CDS Start-End: 1-1071
atgagccatcctgactacagaatgaacctccggcccctggggacccccagaggtgtgtctgctgtggctggtccacatgacattggtgcttcgccaggtgacaaaaagtcaaagaacaggtccacacgagggaagaaaaagagcatatttgaaacttacatgtccaaggaggatgtttcagaaggcttgaagagaggaacactcatccagggtgtattgagaattaatccaaagaagtttcatgaagccttcattccttccccggatggtgatcgagacatttttattgatggggttgttgctcgtaatagagccttaaatggggatctggtggtcgtgaaactgcttcccgaggagcattggaaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaagacaatgaaattgaggctcagagaagttcctgggcttatccagtatcccacaggaagtcagaagagaggatggtgatgcaccggttacaaaagatgagaccacctgcatttcacaagacacaagagctttatcggagaaatccctgcaaagatcagcaaaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaaggtaaactactaccagagataaaagaagaaagagatgttcagagagagcttcggatagagagactttctggcctggtgggactcggctgccctcattgcacccttaggcatggaaagctgcattctgaacaccagcaagcctagctataaatcttcttggacaggaaataaaagagtcagagaccaagccatctctgccctgcatacaaactctcttggttgagttgtgcccagtagttcagtgctttcagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaaggccaggatgccaaactcctgacatcaagcagtccacccgccttgacttcccaaagtgctgggattgcaggcatgagccaccgtgcttggccaaaattcactagattttgaaagcagttcttgacccatggcttatgtgaaagcaaatgcccgatcagggtgcagtggttgccctgtgctggagcattcactagggaaaaagaccgcagaccctgggaggctgcagaccctgtgacctgaatgctggatgctggagggaacctccagaccacttgtgaaatgtgaaagagaacagtggaatagaactgaaactgacgttccctgagcatgctgaaggcagactgtacagcccaatgtagacgcacaggaggagtgactgggtttggaatgaaatgtagaaaaggaagcaagctaaatcaccaggggaaacccttgagaccacaagaatgaagaggtcatggccctgtcattccagaggaggctggagcagctcttcaggaaatgtggatgtgcgaagaggacaagcctggctgagcctaaaaggggctcttcagactcttctggagacctgcacatggcactccccactgggactgtcaggtggtacctggaattgactctacagttgcttttgcccacagcacacacatgcttcctgagagccaaattcagacctgcttgccacagtggaagatttgtgagattatttgaatcccttatatctttggatagtggtagttcttggaataatatggaaagaatagtttcaggatttttttaaaagaaaagttaaagtcagtgattacagattcaagattcttataagactttgctctggataaaaatatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagcggctctaggcctggcagagaaggcacagcagcccctgagtcccagaactgcctctggctctgccctgctggggcccctcccatgtccctgcctctgacgccatcacctccaaggaggtacaagccaagctggagctccagagatcggagccgctccggagttagccagagcccgaaaagcctgcattctcctggctcgcctcccagggagctcagaggtgcccttgcccgggaatccgatggcagagagttaccagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcagtgtgccctgaacgcggacccaggccctcaggttgtgtttcataagccttgggagcgctcaggatgcatctgactccccaactctgccctgacccagggcattcttcctggagggggcccccattacagacaggcgagcagaggcttccagaggccgaaggaggggccaggggtcctgctgcagggatggaggcagagctgcgcctcgacatcaggccctgccatccttgtcccctcacggctgggctctgcacaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtgcca

SEQ ID NO: 127104 - DNA, 659 bp, Homo sapiens
  Payload ID: 4903
  Gene Symbol: DIS3L2
  Gene Name: DIS3 like 3'-5' exoribonuclease 2
  ENST ID: ENST00000434477
  CDS Start-End: 1-590
gctttgccgacgtcctggtgcaccgcctcctggctgccgcgttaggctatagggagcgactagacatggcgcccgataccctgcagaaacaggcggaccactgtaacgaccgccgcatggcgtccaagcgcgtgcaggagctcagtaccagtctcttctttgctgttctggtcaaggagagtggccccctggagtcagaagccatggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcaggagacaaagaacccaacctcagagattcctcaactcggagacccagccaggccaccctccagagcatctcagtctgcaagccccttggtgtgctcagagcttccagtcacactgctcatgcctatccgtgcacagccagggattgcccttcgtggaggaaaacttcatgaaacaaaaaacaagctccgtggggaacacagaccatagaggaaaaagaaagctgtagaaaaagaaatgatgaatgccttcctggaggtgagaaagccatcgtgaaac

SEQ ID NO: 127105 - DNA, 843 bp, Homo sapiens
  Payload ID: 4903
  Gene Symbol: DIS3L2
  Gene Name: DIS3 like 3'-5' exoribonuclease 2
  ENST ID: ENST00000418143
  CDS Start-End: 1-499
ggtgatgggcatcctgaagcaagccttcgacgtgctggtgctgcgctacggcgtgcagaagcgcatctactgcaacgcactggccctgcggtcccaccacttccagaaggtgggcaagaagccggaactcacgctggtctgggagcctgaggacatggagcaggagccagcacagcagggcattcttcctggagggggcccccattacagacaggcgagcagaggcttccagaggccgaaggaggggccaggggtcctgctgcagggatggaggcagagctgcgcctcgacatcaggccctgccatccttgtcccctcacggctgggctctgcacaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagtg

SEQ ID NO: 127106 - DNA, 923 bp, Homo sapiens
  Payload ID: 4903
  Gene Symbol: DIS3L2
  Gene Name: DIS3 like 3'-5' exoribonuclease 2
  ENST ID: ENST00000417808
  CDS Start-End: 1-207
cggtcccaccacttccagaaggtgggcaagaagccggaactcacgctggtctgggagcctgaggacatggagcaggagccagcacagcagggtcctttagagaacctgatgaaagctatgagtttacacccaagaaattgtctggaaccgttttcaccaacagtgtgccctgaacgcggacccaggccctcaggttgtgtttcataagccttgggagcgctcaggatgcatctgactccccaactctgccctgacccagggcattcttcctggagggggcccccattacagacaggcgagcagaggcttccagaggccgaaggaggggccaggggtcctgctgcagggatggaggcagagctgcgcctcgacatcaggccctgccatccttgtcccctcacggctgggctctgcacaggtcatcaccatcttcagcctggtggaggtggtcctgcaggcagagtccacagccctcaagtacagcgccatcctgaagcggccaggcacccagggccacctgggccctgagaaggaggaggaggagtctgacggtgagcccgaggactcaagcaccagctgagctccaccagccgcctgccccgcctgccccgcctgcctgtcccgccacactggctttaggacctgttgacacggaggggggtttttaatttggtttttaacaactcaggggtttgtttttatttttatttaatttttgcagctcaacttttaaacaaactgcaggggagagggtggggctggaaggaaggctgaggcctggtcagcagtgaccccagcagagcaggccccagtcctcctgggaggctggccccccttttttctgggccctactgccctcctctgcccaggaaatgggggggtttcagcaactcagtgtcacagaataaaatcaagtgtggagt

SEQ ID NO: 127107 - DNA, 1149 bp, Homo sapiens
  Payload ID: 4903
  Gene Symbol: DIS3L2
  Gene Name: DIS3 like 3'-5' exoribonuclease 2
  ENST ID: ENST00000424049
  CDS Start-End: 1-1149
gaggagttcagcaagagaagggatttaagaaaagactgtatcttcaccattgacccatcaaccgcccgagacctcgatgatgccctctcctgcaagccactcgctgacggcaacttcaaagtgggagttcacattgctgacgtgagttactttgttccggagggatctgatctggataaagtggctgccgagagggctacaagcgtctacttggttcaaaaggtggtccccatgcttcccaggctgctgtgtgaggagctgtgcagcctcaaccccatgtccgacaagctgaccttctctgtgatctggacactgactccagagggcaagatccttgatgaatggtttggccggaccatcatccgctcctgcaccaaacttagctacgagcatgcacagagcatgattgaaagcccaactgagaaaatccctgcgaaagagctgccccccatttccccagagcatagcagcgaggaggtacaccaggccgtcttgaatctccacggaattgccaagcagttacgccagcagcgctttgtggacggcgcacttcgtttggatcagctaaagcttgctttcactctggaccacgagaccggattgcctcaaggatgtcatatctatgagtaccgcgagagcaacaagctcgtggaggagttcatgctcttggccaacatggcagtggcccacaagatccaccgcgccttccccgagcaggccctgctgcgccggcaccccccgccccaaacaaggatgctcagtgacctggtggaattctgcgaccagatggggctgcccgtggacttcagctccgcaggagccctcaataaaagcctgacccaaacatttggagatgacaagtactcactggcccgcaaggaggtgctcaccaacatgtgctcccggcccatgcagatggcactgtacttctgctcggggctgctgcaggacccagcgcagttccggcactacgcgctcaatgtgcccctgtacacacacttcacctcgcccatccgccgctttgccgacgtcctggtgcaccgcctcctggctgccgcgttaggctatagggagcgactagacatggcgcccgataccctgcagaaacaggcggaccactgtaacgaccgccgcatggcgtccaagcgc

SEQ ID NO: 127108 - DNA, 3763 bp, Homo sapiens
  Payload ID: 4904
  Gene Symbol: DIS3L
  Gene Name: DIS3 like exosome 3'-5' exoribonuclease
  Uniprot ID: Q8TF46
  ENST ID: ENST00000319194
  CDS Start-End: 262-3177
attaattacccggtattagtattaatacggcggctccattcccacatggacctgggggggacaaacaaagtctcctaatcttggacagctgcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttggatgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaaaaaaaaaaagttctctcattcattaaagttgcattaaataaagtataattaggtcactatggaaacagagttttcagtaatgagtggacagtaagtggtggctctgcagatggcccctttctaataagtttaataaacccgaaattactggtta

SEQ ID NO: 127109 - DNA, 3647 bp, Homo sapiens
  Payload ID: 4904
  Gene Symbol: DIS3L
  Gene Name: DIS3 like exosome 3'-5' exoribonuclease
  Uniprot ID: Q8TF46
  ENST ID: ENST00000319212
  CDS Start-End: 51-3215
cttgcctccgccgcgcccgccactccgcggccgccgggagacacgccgccatgctgcagaagcgggagaaggtgctgctgctgaggaccttccagggccgcacgctgcggatcgtgcgcgagcactacctgcggccctgcgtgccctgccacagcccgctctgcccgcagcccgccgcctgcagccacgatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttggatgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctcaaaaaaaaaaaaaaaa

SEQ ID NO: 127110 - DNA, 873 bp, Homo sapiens
  Payload ID: 4904
  Gene Symbol: DIS3L
  Gene Name: DIS3 like exosome 3'-5' exoribonuclease
  ENST ID: ENST00000525109
  CDS Start-End: 423-873
cagggccgcacgctgcggatcgtgcgcgagcactacctgcggccctgcgtgccctgccacagcccgctctgcccgcagcccgccgcctgcagccacgatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagcaagagatagcagtggatgagtacctgctttgttagagttatttttctcctccgtgtcacagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctc

SEQ ID NO: 127111 - DNA, 3260 bp, Homo sapiens
  Payload ID: 4904
  Gene Symbol: DIS3L
  Gene Name: DIS3 like exosome 3'-5' exoribonuclease
  ENST ID: ENST00000530537
  CDS Start-End: 2-169
catgcagacagcttgtcaagctgtgcagcatcaaagaggcaggagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggtcgagtggtgggcatacttcagaagaactggcgggattatgtggtgacatttccgtccaaagaagaggtccaatctcagggcaaaaatgctcagaaaatcctggttacaccttgggattacagaattcccaaaattcgaattagcactcagcaagcagaaaccctccaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccagaattcaaagacttggatgagaagagcagacaagccaagctggaggagttggtgtgggcaattggaaagctgaccgacatagctcgccatgtcagagctaaacgagacggatgtggtgccctggaactggaaggggtagaggtttgcgtacagctagatgacaaaaagaacattcacgacctcatccccaagcagcccctggaagtccacgagacagtggctgaatgcatgatcctggccaaccactgggtcgccaaaaagatctgggagagcttccctcatcaggccttgctgcgccagcaccctcctccacaccaggagttcttttcagaactccgggaatgtgctaaagccaaaggcttcttcatagatacacggtccaataaaacactggctgattctctggataatgcgaacgacccccacgatcccattgtgaacaggctactgcgctccatggccacgcaggccatgtcgaatgctctgtacttctccaccggatcctgtgcggaggaggagttccatcattacggtcttgcattagataaatatacccactttacttctccaataagaagatattcagatattgtagtacaccgcttgttaatggcagccatttcaaaagataagaaaatggaaattaagggaaatctgttcagcaacaaagatcttgaggaattatgcagacatatcaacaacagaaaccaagcagcacagcattctcagaagcagtctactgagctcttccagtgcatgtacttcaaagacaaagaccctgccaccgaggagcgttgcatatctgacggagttatttattcaattagaacaaatggtgtgcttctatttataccaaggtttgggattaaaggtgctgcttatctaaaaaataaagatggtttagtcatctcatgtggcccagatagctgttctgaatggaaaccaggatcccttcaacgatttcaaaacaaaattacctctactacaacagatggggaatctgttacgttccatttgtttgaccatgtaaccgtaagaatatccatacaggcctcacgttgccattctgatacaatcagacttgaaataattagtaacaaaccatacaagataccaaatacagaacttattcatcagagttcccccttgctgaagagtgagttagtgaaagaagtaactaaatctgtggaagaagctcagcttgcccaagaagtcaaagtaaacatcattcaggaggaatatcaagaatatcgccaaacaaagggaaggagcctatacacacttctagaggagatacgggacctagctctcctggatgtttcaaacaattatggaatatgagaggctcttacttcactaagagctgtcatatgtgaatgttttacagtcttttcaaacttaacatttaatgtgtgtcactcagtgctctagtcgatcaggactgggtagctatttcgcatatatgtaaaatgttctcagccgggcacggtggctcacgcctgtaaccccagcactttgggaggctgaggcgggcggatcacgaggtcaggagattgagaccatcctggctaacacggtgaaacccagtctctactaaaaatacaaaaattagcccggcgtggtggcatgcgcctgtagtcccagctacttgggaggctgaagcaggagaattgcctgaacccaggaagaggaggttgcagtgagccgagatcgcaccactgcattccagcctgggcaacagagcgagactccatctc

SEQ ID NO: 127112 - DNA, 1504 bp, Homo sapiens
  Payload ID: 4904
  Gene Symbol: DIS3L
  Gene Name: DIS3 like exosome 3'-5' exoribonuclease
  ENST ID: ENST00000524795
  CDS Start-End: 172-339
gcgcccagcccttcttcacctgccgtccaggtatcatcctagtcttccctccgtctctgggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaagaattacctggacaatttctggcctgatttaaaagctgcccacgagctttgtgattctatccttcagtctcgacgggagagagagaatgagagtcaggagagccatgggaaggagtacccagaacatcttcccctggaagtgttagaagctgggattaaatctggacgctatatccagggaattctgaatgtcaacaaacacagagcccaaatagaagcttttgttcgacttcaaggagccagcagtaaagattcagatttagtcagtgacatcctaatccacgggatgaaggctcgaaaccgctcaattcatggagatgtggtagttgtggagctgcttcctaaaaatgaatggaaaggaagaaccgtagccctgtgtgagaatgactgtgacgacaaggcttcgggcgagtccccaagtgagcccatgcctacaggacttcagggtggtcgtgcgcatcgattcctgggagtcaacatctgtgtatccaaatggacattttgtgcgtgttttaggaagaatcggagatctggaaggggaaattgcaaccatcctggtggaaaacagtatttcagttattcctttctcagaagctcagatgtgtgagatgccagtaaacacaccagaaagtccctggaaggtgagtcctgaagaggaacaaaaacgtaaagacttgaggaaaagccatctcgtattcagcattgaccccaaaggttgtgaagatgtggatgacacactctcagtcagaaccttaaataatggcaacctggaacttggggtccacatcgcagatgtaacacactttgtggcaccaaattcttacattgatattgaagctagaacaagggccaccacttattatctagcagatcgtcgctatgacatgctgccttccgtcctcagtgcagatttgtgttcccttctgggaggcgttgataggtatgctgtaagcatcatgtgggaactggataaagcctcttatgaaattaagaaagtgtggtatggcagaaccattattcgatcagcatacaaactgttctatgaagcagcccaagaactactggatggaaacttaagcgttgttgatgatattccag

SEQ ID NO: 127113 - DNA, 327 bp, Homo sapiens
  Payload ID: 4904
  Gene Symbol: DIS3L
  Gene Name: DIS3 like exosome 3'-5' exoribonuclease
  ENST ID: ENST00000525134
  CDS Start-End: 157-327
ctaatcttggacagctgcgcccagcccttcttcacctgccgtccagatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagacc

SEQ ID NO: 127114 - DNA, 792 bp, Homo sapiens
  Payload ID: 4904
  Gene Symbol: DIS3L
  Gene Name: DIS3 like exosome 3'-5' exoribonuclease
  ENST ID: ENST00000530615
  CDS Start-End: 501-792
tcccgccgcaacctcgcgccgtggagaaatggggaggtcccgagctgggagcccccgggagctacaggccagctgctgccgctgcgaagctgacatcgcctgctttgcagccacaggtttcctgacctgcccgcactgttgccccagacttttcccccagtggagagccacttcaccgtagatttgtgaactctctgggcccgcactggagcggaaggtcacggggaagttggactggggactcctgggccccagtccttggtttctaggccacaagggtggccgatagaacgatgcacgttactggctctcttcccccatgggaggatgagaatgggctgggggtccttgtcagcgaatgtgtggaatcctccaaacattgtgattaagatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtat

SEQ ID NO: 127115 - DNA, 504 bp, Homo sapiens
  Payload ID: 4904
  Gene Symbol: DIS3L
  Gene Name: DIS3 like exosome 3'-5' exoribonuclease
  ENST ID: ENST00000532580
  CDS Start-End: 196-504
gacacggaggcgtaggccccgcggcctgcgcccgctcgccggcctcaccccccggctctctgccggtggggacccagcggcccggatgggaaactcttgtctagtgatgtgactcattacgtgatcccagactggaaagttgttcaagattatcttgagatccttgagtttcctgagttgaagggaattattttcatgcagacagcttgtcaagctgtgcagcatcaaagaggcaggagacagtataacaaactgcgaaacctgctgaaggatgcgcgtcatgattgcattctctttgctaatgaattccagcaatgctgctatctgccacgggaaagaggagagtccatggagaagtggcagaccaggagcatatacaacgcagctgtttggtactatcatcactgccaggacaggatgccaattgttatggtgacagaagatgaagaggcaattcagcagtatggaagtgaaacagaaggagtattcgtgattactttcaag

SEQ ID NO: 127116 - DNA, 3845 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000259875
  CDS Start-End: 355-2985
gatcccagaagtaggaggggcgtcttcccctcgtgggccctgagcgggactgcagccagccccctggggagccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127117 - DNA, 4148 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000324771
  CDS Start-End: 549-3290
cctttggttctgtttcacagttctcagcctcccctccctttctccacagccaggctgctcagtccctctctgcgggggcctagaggctcggtgaggggagcgggacttggttgccatggtcacattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccac

SEQ ID NO: 127118 - DNA, 3832 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000376567
  CDS Start-End: 342-2972
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127119 - DNA, 3894 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000376568
  CDS Start-End: 296-3037
ggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcca

SEQ ID NO: 127120 - DNA, 3783 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000376569
  CDS Start-End: 293-2923
agaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127121 - DNA, 3820 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000376570
  CDS Start-End: 334-2964
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127122 - DNA, 732 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000376575
  CDS Start-End: 1-732
atgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctga

SEQ ID NO: 127123 - DNA, 3971 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000383377
  CDS Start-End: 370-3111
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127124 - DNA, 675 bp, Homo sapiens
  Payload ID: 4905
  Gene Symbol: DDR1
  Gene Name: discoidin domain receptor tyrosine kinase 1
  ENST ID: ENST00000396342
  CDS Start-End: 233-675
ctggaggggtaggtgttctgggggaatgaatccctgggggcttggtgggacaggaaggcgggaagaagctgctcttcgagtgaccctggggctgtctgttagcaggtccctcagccgttggaacgtccttgggcttctgaactagtgcccatgtgtgcctcggcctttcccaagggccagcttcttcctgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctga

SEQ ID NO: 127125 - DNA, 560 bp, Homo sapiens
  Payload ID: 4905
  Gene Symbol: DDR1
  Gene Name: discoidin domain receptor tyrosine kinase 1
  ENST ID: ENST00000400407
  CDS Start-End: 118-560
cgttggaacgtccttgggcttctgaactagtgcccatgtgtgcctcggcctttcccaagggccagcttcttcctgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctga

SEQ ID NO: 127126 - DNA, 3832 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000400410
  CDS Start-End: 342-2972
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127127 - DNA, 3678 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000400411
  CDS Start-End: 188-2818
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127128 - DNA, 3968 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000400414
  CDS Start-End: 367-3108
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127129 - DNA, 560 bp, Homo sapiens; identical to SEQ ID NO: 127125
  Payload ID: 4905
  Gene Symbol: DDR1
  Gene Name: discoidin domain receptor tyrosine kinase 1
  ENST ID: ENST00000400484
  CDS Start-End: 118-560

SEQ ID NO: 127130 - DNA, 3832 bp, Homo sapiens; identical to SEQ ID NO: 127118
  Payload ID: 4905
  Gene Symbol: DDR1
  Gene Name: discoidin domain receptor tyrosine kinase 1
  Uniprot ID: Q08345
  ENST ID: ENST00000400486
  CDS Start-End: 342-2972

SEQ ID NO: 127131 - DNA, 3678 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000400488
  CDS Start-End: 188-2818
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127132 - DNA, 3845 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000400489
  CDS Start-End: 355-2985
gatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127133 - DNA, 3968 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000400491
  CDS Start-End: 367-3108
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127134 - DNA, 3971 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000400492
  CDS Start-End: 370-3111
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127135 - DNA, 758 bp, Homo sapiens
  Payload ID: 4905
  Gene Symbol: DDR1
  Gene Name: discoidin domain receptor tyrosine kinase 1
  ENST ID: ENST00000434428
  CDS Start-End: 342-758
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 127136 - DNA, 588 bp, Homo sapiens
  Payload ID: 4905
  Gene Symbol: DDR1
  Gene Name: discoidin domain receptor tyrosine kinase 1
  ENST ID: ENST00000433393
  CDS Start-End: 172-588
ctgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 127137 - DNA, 873 bp, Homo sapiens
  Payload ID: 4905
  Gene Symbol: DDR1
  Gene Name: discoidin domain receptor tyrosine kinase 1
  ENST ID: ENST00000418397
  CDS Start-End: 457-873
gggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 127138 - DNA, 873 bp, Homo sapiens
  Payload ID: 4905
  Gene Symbol: DDR1
  Gene Name: discoidin domain receptor tyrosine kinase 1
  ENST ID: ENST00000414794
  CDS Start-End: 457-873
gggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 127139 - DNA, 1257 bp, Homo sapiens
  Payload ID: 4905
  Gene Symbol: DDR1
  Gene Name: discoidin domain receptor tyrosine kinase 1
  ENST ID: ENST00000428153
  CDS Start-End: 457-1257
gggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctat

SEQ ID NO: 127140 - DNA, 1479 bp, Homo sapiens
  Payload ID: 4905
  Gene Symbol: DDR1
  Gene Name: discoidin domain receptor tyrosine kinase 1
  ENST ID: ENST00000442268
  CDS Start-End: 1-1479
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaac

SEQ ID NO: 127141 - DNA, 485 bp, Homo sapiens
  Payload ID: 4905
  Gene Symbol: DDR1
  Gene Name: discoidin domain receptor tyrosine kinase 1
  ENST ID: ENST00000452052
  CDS Start-End: 296-485
ggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggt

SEQ ID NO: 127142 - DNA, 3971 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000412329
  CDS Start-End: 370-3111
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127143 - DNA, 459 bp, Homo sapiens
  Payload ID: 4905
  Gene Symbol: DDR1
  Gene Name: discoidin domain receptor tyrosine kinase 1
  ENST ID: ENST00000444160
  CDS Start-End: 43-459
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 127144 - DNA, 873 bp, Homo sapiens; identical to SEQ ID NO: 127137
  Payload ID: 4905
  Gene Symbol: DDR1
  Gene Name: discoidin domain receptor tyrosine kinase 1
  ENST ID: ENST00000451632
  CDS Start-End: 457-873

SEQ ID NO: 127145 - DNA, 496 bp, Homo sapiens
  Payload ID: 4905
  Gene Symbol: DDR1
  Gene Name: discoidin domain receptor tyrosine kinase 1
  ENST ID: ENST00000412274
  CDS Start-End: 322-496
agtccagcgtctcctgggcctagattccccagctgctgttctctggaggggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccg

SEQ ID NO: 127146 - DNA, 873 bp, Homo sapiens; identical to SEQ ID NO: 127137
  Payload ID: 4905
  Gene Symbol: DDR1
  Gene Name: discoidin domain receptor tyrosine kinase 1
  ENST ID: ENST00000416705
  CDS Start-End: 457-873

SEQ ID NO: 127147 - DNA, 515 bp, Homo sapiens
  Payload ID: 4905
  Gene Symbol: DDR1
  Gene Name: discoidin domain receptor tyrosine kinase 1
  ENST ID: ENST00000422275
  CDS Start-End: 99-515
gtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggag

SEQ ID NO: 127148 - DNA, 1479 bp, Homo sapiens
  Payload ID: 4905
  Gene Symbol: DDR1
  Gene Name: discoidin domain receptor tyrosine kinase 1
  ENST ID: ENST00000444198
  CDS Start-End: 1-1479
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaac

SEQ ID NO: 127149 - DNA, 587 bp, Homo sapiens
  Payload ID: 4905
  Gene Symbol: DDR1
  Gene Name: discoidin domain receptor tyrosine kinase 1
  ENST ID: ENST00000437124
  CDS Start-End: 128-587
agattccccagctgctgttctctggaggggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaagg

SEQ ID NO: 127150 - DNA, 459 bp, Homo sapiens; identical to SEQ ID NO: 127143
  Payload ID: 4905
  Gene Symbol: DDR1
  Gene Name: discoidin domain receptor tyrosine kinase 1
  ENST ID: ENST00000445749
  CDS Start-End: 43-459

SEQ ID NO: 127151 - DNA, 939 bp, Homo sapiens
  Payload ID: 4905
  Gene Symbol: DDR1
  Gene Name: discoidin domain receptor tyrosine kinase 1
  ENST ID: ENST00000414077
  CDS Start-End: 188-939
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 127152 - DNA, 1996 bp, Homo sapiens
  Payload ID: 4905
  Gene Symbol: DDR1
  Gene Name: discoidin domain receptor tyrosine kinase 1
  ENST ID: ENST00000450117
  CDS Start-End: 1-1136
cctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127153 - DNA, 1121 bp, Homo sapiens
  Payload ID: 4905
  Gene Symbol: DDR1
  Gene Name: discoidin domain receptor tyrosine kinase 1
  ENST ID: ENST00000422628
  CDS Start-End: 370-1121
gacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 127154 - DNA, 580 bp, Homo sapiens
  Payload ID: 4905
  Gene Symbol: DDR1
  Gene Name: discoidin domain receptor tyrosine kinase 1
  ENST ID: ENST00000413044
  CDS Start-End: 81-580
cctgggcctagattccccagctgctgttctctggagggagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttcta

SEQ ID NO: 127155 - DNA, 3971 bp, Homo sapiens; identical to SEQ ID NO: 127134
  Payload ID: 4905
  Gene Symbol: DDR1
  Gene Name: discoidin domain receptor tyrosine kinase 1
  Uniprot ID: Q08345
  ENST ID: ENST00000430933
  CDS Start-End: 370-3111

SEQ ID NO: 127156 - DNA, 485 bp, Homo sapiens; identical to SEQ ID NO: 127141
  Payload ID: 4905
  Gene Symbol: DDR1
  Gene Name: discoidin domain receptor tyrosine kinase 1
  ENST ID: ENST00000434782
  CDS Start-End: 296-485

SEQ ID NO: 127157 - DNA, 1996 bp, Homo sapiens
  Payload ID: 4905
  Gene Symbol: DDR1
  Gene Name: discoidin domain receptor tyrosine kinase 1
  ENST ID: ENST00000452093
  CDS Start-End: 1-1136
cctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127158 - DNA, 485 bp, Homo sapiens; identical to SEQ ID NO: 127141
  Payload ID: 4905
  Gene Symbol: DDR1
  Gene Name: discoidin domain receptor tyrosine kinase 1
  ENST ID: ENST00000439604
  CDS Start-End: 296-485

SEQ ID NO: 127159 - DNA, 1479 bp, Homo sapiens; identical to SEQ ID NO: 127140
  Payload ID: 4905
  Gene Symbol: DDR1
  Gene Name: discoidin domain receptor tyrosine kinase 1
  ENST ID: ENST00000417521
  CDS Start-End: 1-1479

SEQ ID NO: 127160 - DNA, 1093 bp, Homo sapiens
  Payload ID: 4905
  Gene Symbol: DDR1
  Gene Name: discoidin domain receptor tyrosine kinase 1
  ENST ID: ENST00000433322
  CDS Start-End: 342-1093
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 127161 - DNA, 560 bp, Homo sapiens; identical to SEQ ID NO: 127125
  Payload ID: 4905
  Gene Symbol: DDR1
  Gene Name: discoidin domain receptor tyrosine kinase 1
  ENST ID: ENST00000453391
  CDS Start-End: 118-560

SEQ ID NO: 127162 - DNA, 3678 bp, Homo sapiens; identical to SEQ ID NO: 127131
  Payload ID: 4905
  Gene Symbol: DDR1
  Gene Name: discoidin domain receptor tyrosine kinase 1
  Uniprot ID: Q08345
  ENST ID: ENST00000454774
  CDS Start-End: 188-2818

SEQ ID NO: 127163 - DNA, 799 bp, Homo sapiens
  Payload ID: 4905
  Gene Symbol: DDR1
  Gene Name: discoidin domain receptor tyrosine kinase 1
  ENST ID: ENST00000437449
  CDS Start-End: 172-799
ctgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacc

SEQ ID NO: 127164 - DNA, 580 bp, Homo sapiens; identical to SEQ ID NO: 127154
  Payload ID: 4905
  Gene Symbol: DDR1
  Gene Name: discoidin domain receptor tyrosine kinase 1
  ENST ID: ENST00000448651
  CDS Start-End: 81-580

SEQ ID NO: 127165 - DNA, 3832 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000453510
  CDS Start-End: 342-2972
ggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127166 - DNA, 1118 bp, Homo sapiens
  Payload ID: 4905
  Gene Symbol: DDR1
  Gene Name: discoidin domain receptor tyrosine kinase 1
  ENST ID: ENST00000426303
  CDS Start-End: 367-1118
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 127167 - DNA, 3968 bp, Homo sapiens; identical to SEQ ID NO: 127133
  Payload ID: 4905
  Gene Symbol: DDR1
  Gene Name: discoidin domain receptor tyrosine kinase 1
  Uniprot ID: Q08345
  ENST ID: ENST00000429699
  CDS Start-End: 367-3108

SEQ ID NO: 127168 - DNA, 515 bp, Homo sapiens; identical to SEQ ID NO: 127147
  Payload ID: 4905
  Gene Symbol: DDR1
  Gene Name: discoidin domain receptor tyrosine kinase 1
  ENST ID: ENST00000421499
  CDS Start-End: 99-515

SEQ ID NO: 127169 - DNA, 459 bp, Homo sapiens; identical to SEQ ID NO: 127143
  Payload ID: 4905
  Gene Symbol: DDR1
  Gene Name: discoidin domain receptor tyrosine kinase 1
  ENST ID: ENST00000429955
  CDS Start-End: 43-459

SEQ ID NO: 127170 - DNA, 560 bp, Homo sapiens
  Payload ID: 4905
  Gene Symbol: DDR1
  Gene Name: discoidin domain receptor tyrosine kinase 1
  ENST ID: ENST00000445017
  CDS Start-End: 118-560
cgttggaacgtccttgggcttctgaactagtgcccatgtgtgcctcggcctttcccaagggccagcttcttcctgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctga

SEQ ID NO: 127171 - DNA, 799 bp, Homo sapiens; identical to SEQ ID NO: 127163
  Payload ID: 4905
  Gene Symbol: DDR1
  Gene Name: discoidin domain receptor tyrosine kinase 1
  ENST ID: ENST00000439772
  CDS Start-End: 172-799

SEQ ID NO: 127172 - DNA, 1479 bp, Homo sapiens; identical to SEQ ID NO: 127140
  Payload ID: 4905
  Gene Symbol: DDR1
  Gene Name: discoidin domain receptor tyrosine kinase 1
  ENST ID: ENST00000414378
  CDS Start-End: 1-1479

SEQ ID NO: 127173 - DNA, 1106 bp, Homo sapiens
  Payload ID: 4905
  Gene Symbol: DDR1
  Gene Name: discoidin domain receptor tyrosine kinase 1
  ENST ID: ENST00000421672
  CDS Start-End: 355-1106
gatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 127174 - DNA, 799 bp, Homo sapiens; identical to SEQ ID NO: 127163
  Payload ID: 4905
  Gene Symbol: DDR1
  Gene Name: discoidin domain receptor tyrosine kinase 1
  ENST ID: ENST00000419285
  CDS Start-End: 172-799

SEQ ID NO: 127175 - DNA, 232 bp, Homo sapiens
  Payload ID: 4905
  Gene Symbol: DDR1
  Gene Name: discoidin domain receptor tyrosine kinase 1
  ENST ID: ENST00000430486
  CDS Start-End: 43-232
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggt

SEQ ID NO: 127176 - DNA, 3857 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000452441
  CDS Start-End: 260-3001
tgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127177 - DNA, 1479 bp, Homo sapiens
  Payload ID: 4905
  Gene Symbol: DDR1
  Gene Name: discoidin domain receptor tyrosine kinase 1
  ENST ID: ENST00000433244
  CDS Start-End: 1-1479
tctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaac

SEQ ID NO: 127178 - DNA, 3678 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000415092
  CDS Start-End: 188-2818
ctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127179 - DNA, 1996 bp, Homo sapiens; identical to SEQ ID NO: 127152
  Payload ID: 4905
  Gene Symbol: DDR1
  Gene Name: discoidin domain receptor tyrosine kinase 1
  ENST ID: ENST00000446697
  CDS Start-End: 1-1136

SEQ ID NO: 127180 - DNA, 3202 bp, Homo sapiens
  Payload ID: 4905
  Gene Symbol: DDR1
  Gene Name: discoidin domain receptor tyrosine kinase 1
  ENST ID: ENST00000446312
  CDS Start-End: 43-2346
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127181 - DNA, 485 bp, Homo sapiens; identical to SEQ ID NO: 127141
  Payload ID: 4905
  Gene Symbol: DDR1
  Gene Name: discoidin domain receptor tyrosine kinase 1
  ENST ID: ENST00000431334
  CDS Start-End: 296-485

SEQ ID NO: 127182 - DNA, 3942 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000454612
  CDS Start-End: 452-3082
agattccccagctgctgttctctggaggggttcctggggcggagatgtgcagtggagcgagaacttcctgtgaccgtgacattgtctaggtggaaccgatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127183 - DNA, 485 bp, Homo sapiens; identical to SEQ ID NO: 127141
  Payload ID: 4905
  Gene Symbol: DDR1
  Gene Name: discoidin domain receptor tyrosine kinase 1
  ENST ID: ENST00000448263
  CDS Start-End: 296-485

SEQ ID NO: 127184 - DNA, 459 bp, Homo sapiens; identical to SEQ ID NO: 127143
  Payload ID: 4905
  Gene Symbol: DDR1
  Gene Name: discoidin domain receptor tyrosine kinase 1
  ENST ID: ENST00000458576
  CDS Start-End: 43-459

SEQ ID NO: 127185 - DNA, 560 bp, Homo sapiens; identical to SEQ ID NO: 127125
  Payload ID: 4905
  Gene Symbol: DDR1
  Gene Name: discoidin domain receptor tyrosine kinase 1
  ENST ID: ENST00000454377
  CDS Start-End: 118-560

SEQ ID NO: 127186 - DNA, 580 bp, Homo sapiens; identical to SEQ ID NO: 127154
  Payload ID: 4905
  Gene Symbol: DDR1
  Gene Name: discoidin domain receptor tyrosine kinase 1
  ENST ID: ENST00000435818
  CDS Start-End: 81-580

SEQ ID NO: 127187 - DNA, 3588 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000418800
  CDS Start-End: 414-3044
agcctagagctggggcgaggtgggcatcaccactaggaatttctcctgaggcagtgagaagaggggacaaaggtttcaggactctctagctccttctgctctccccagtggacccctctgtctggcactgccatgccacttagctggggtcagcgtgggcctggggtgtggaatgtcccaccagggtatgacgggctgtagcttgcctggcaggcctgttggggctttcccagagcacagctcctggaaggaggggctgtgggctgccaggtgaggtgacttgggaagccttggccccacccccaggctggccccacccccagtccagcgtctcctgggcctagattccccagctgctgttctctggagggagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactg

SEQ ID NO: 127188 - DNA, 1996 bp, Homo sapiens
  Payload ID: 4905
  Gene Symbol: DDR1
  Gene Name: discoidin domain receptor tyrosine kinase 1
  ENST ID: ENST00000416487
  CDS Start-End: 1-1136
cctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127189 - DNA, 580 bp, Homo sapiens; identical to SEQ ID NO: 127154
  Payload ID: 4905
  Gene Symbol: DDR1
  Gene Name: discoidin domain receptor tyrosine kinase 1
  ENST ID: ENST00000438728
  CDS Start-End: 81-580

SEQ ID NO: 127190 - DNA, 587 bp, Homo sapiens
  Payload ID: 4905
  Gene Symbol: DDR1
  Gene Name: discoidin domain receptor tyrosine kinase 1
  ENST ID: ENST00000424544
  CDS Start-End: 1-587
atctttactgctgctgctcttggtggcaagtggagatgctgacatgaagggacattttgatcctgccaagtgccgctatgccctgggcatgcaggaccggaccatcccagacagtgacatctctgcttccagctcctggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgact

SEQ ID NO: 127191 - DNA, 800 bp, Homo sapiens
  Payload ID: 4905
  Gene Symbol: DDR1
  Gene Name: discoidin domain receptor tyrosine kinase 1
  ENST ID: ENST00000421124
  CDS Start-End: 173-800
actgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacc

SEQ ID NO: 127192 - DNA, 140 bp, Homo sapiens
  Payload ID: 4905
  Gene Symbol: DDR1
  Gene Name: discoidin domain receptor tyrosine kinase 1
  ENST ID: ENST00000448537
  CDS Start-End: 1-140
tctgaggccgtgtacctcaacgactccacctatgacggacataccgtgggcggactgcagtatgggggtctgggccagctggcagatggtgtggtggggctggatgactttaggaagagtcaggagctgcgggtctggcc

SEQ ID NO: 127193 - DNA, 3968 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000449518
  CDS Start-End: 367-3108
gaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127194 - DNA, 459 bp, Homo sapiens; identical to SEQ ID NO: 127143
  Payload ID: 4905
  Gene Symbol: DDR1
  Gene Name: discoidin domain receptor tyrosine kinase 1
  ENST ID: ENST00000413115
  CDS Start-End: 43-459

SEQ ID NO: 127195 - DNA, 873 bp, Homo sapiens; identical to SEQ ID NO: 127137
  Payload ID: 4905
  Gene Symbol: DDR1
  Gene Name: discoidin domain receptor tyrosine kinase 1
  ENST ID: ENST00000440427
  CDS Start-End: 457-873

SEQ ID NO: 127196 - DNA, 3845 bp, Homo sapiens; identical to SEQ ID NO: 127132
  Payload ID: 4905
  Gene Symbol: DDR1
  Gene Name: discoidin domain receptor tyrosine kinase 1
  Uniprot ID: Q08345
  ENST ID: ENST00000421229
  CDS Start-End: 355-2985

SEQ ID NO: 127197 - DNA, 799 bp, Homo sapiens; identical to SEQ ID NO: 127163
  Payload ID: 4905
  Gene Symbol: DDR1
  Gene Name: discoidin domain receptor tyrosine kinase 1
  ENST ID: ENST00000434134
  CDS Start-End: 172-799

SEQ ID NO: 127198 - DNA, 799 bp, Homo sapiens
  Payload ID: 4905
  Gene Symbol: DDR1
  Gene Name: discoidin domain receptor tyrosine kinase 1
  ENST ID: ENST00000420929
  CDS Start-End: 172-799
ctgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacc

SEQ ID NO: 127199 - DNA, 3845 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000427053
  CDS Start-End: 355-2985
gatcccagaagtaggaggggcgtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 127200 - DNA, 3832 bp, Homo sapiens; identical to SEQ ID NO: 127118
  Payload ID: 4905
  Gene Symbol: DDR1
  Gene Name: discoidin domain receptor tyrosine kinase 1
  Uniprot ID: Q08345
  ENST ID: ENST00000419412
  CDS Start-End: 342-2972

SEQ ID NO: 127201 - DNA, 673 bp, Homo sapiens
  Payload ID: 4905
  Gene Symbol: DDR1
  Gene Name: discoidin domain receptor tyrosine kinase 1
  ENST ID: ENST00000505534
  CDS Start-End: 372-673
acattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtggg

SEQ ID NO: 127202 - DNA, 481 bp, Homo sapiens
  Payload ID: 4905
  Gene Symbol: DDR1
  Gene Name: discoidin domain receptor tyrosine kinase 1
  ENST ID: ENST00000515219
  CDS Start-End: 274-481
gctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtc

SEQ ID NO: 127203 - DNA, 556 bp, Homo sapiens
  Payload ID: 4905
  Gene Symbol: DDR1
  Gene Name: discoidin domain receptor tyrosine kinase 1
  ENST ID: ENST00000505066
  CDS Start-End: 159-556
agttagacatggaacttaatagttttcacaggtattcacgagtcctcaggagtccagagacctcagtttgagaacactatcctagcactgaccttgacttccagggtgaccttgagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaa

SEQ ID NO: 127204 - DNA, 572 bp, Homo sapiens
  Payload ID: 4905
  Gene Symbol: DDR1
  Gene Name: discoidin domain receptor tyrosine kinase 1
  ENST ID: ENST00000512336
  CDS Start-End: 237-572
agtgcggaggaactgagccccgggaggaggtgctcctgtgcagccccactgagtcagctcatctatcgcctgccctccacctggccagtccctgcgggcatctaactgctaagcctccgctcagccaacacccagttggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaag

SEQ ID NO: 127205 - DNA, 584 bp, Homo sapiens
  Payload ID: 4905
  Gene Symbol: DDR1
  Gene Name: discoidin domain receptor tyrosine kinase 1
  ENST ID: ENST00000513749
  CDS Start-End: 182-289
agctggcccgggcagctgctcctcctgggcccggggccccggacgctcggacaaagccaggcagcgttggcagccccagacccgaccccaaaggcctgagactggggtgactgggacctaagagaatcctgagctggagagatgctgcccccacccccttaggcccgagggatcaggagctatgggaccagaggccctgtcatctttactgctgctgctcttggtggcaagtggagatgctgacatgaagggacattttgatcctggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaat

SEQ ID NO: 127206 - DNA, 2673 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000482873
  CDS Start-End: 198-929
cgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgacc

SEQ ID NO: 127207 - DNA, 539 bp, Homo sapiens
  Payload ID: 4905
  Gene Symbol: DDR1
  Gene Name: discoidin domain receptor tyrosine kinase 1
  ENST ID: ENST00000512725
  CDS Start-End: 124-539
ccagaggcaggcgcccaagctcgctggctgttgctgagggcctgtaggtgtgtccaggactgagtggtgtggtggagacagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcagga

SEQ ID NO: 127208 - DNA, 615 bp, Homo sapiens
  Payload ID: 4905
  Gene Symbol: DDR1
  Gene Name: discoidin domain receptor tyrosine kinase 1
  ENST ID: ENST00000509639
  CDS Start-End: 272-615
acccccagtccagcgtctcctgggcctagattccccagctgctgttctctggaggggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctc

SEQ ID NO: 127209 - DNA, 3073 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000508312
  CDS Start-End: 253-2937
cccctctcactcagtgcggaggaactgagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgca

SEQ ID NO: 127210 - DNA, 580 bp, Homo sapiens
  Payload ID: 4905
  Gene Symbol: DDR1
  Gene Name: discoidin domain receptor tyrosine kinase 1
  ENST ID: ENST00000515233
  CDS Start-End: 166-580
gtgtttctttcttgggattgttgtctgggactgcaagcagggtatgtttttatctactgtgaggttcctggggcggagatgtgcagtggagcgagaacttcctgtgaccgtgacattgtctagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcagg

SEQ ID NO: 127211 - DNA, 572 bp, Homo sapiens
  Payload ID: 4905
  Gene Symbol: DDR1
  Gene Name: discoidin domain receptor tyrosine kinase 1
  ENST ID: ENST00000503670
  CDS Start-End: 448-572
agaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagattttgattgagcaggtcaagggtgagcctgagattctgatttcttccatgcttccagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccat

SEQ ID NO: 127212 - DNA, 956 bp, Homo sapiens
  Payload ID: 4905
  Gene Symbol: DDR1
  Gene Name: discoidin domain receptor tyrosine kinase 1
  ENST ID: ENST00000515881
  CDS Start-End: 701-956
cagttgctttgcctactcagtctcactgtttcatcttccctgggtctcttggtccccttccttttgactgtgtgtgattttcagtgtgcctccatccttctcctgctcctcttcttcctcctcccgaccactcaactttgtcctggcctcatttttggcctcttctggccagtgatcagaccctctggcccactacggccagagctggctgggcctgagggaggcttgccctgaggactcctgagtccccctcccactccactccgttgggagcccaggggaatcagggcctgggcgtctggacccccgggtcccttagaacgcccttcagagagaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagt

SEQ ID NO: 127213 - DNA, 636 bp, Homo sapiens
  Payload ID: 4905
  Gene Symbol: DDR1
  Gene Name: discoidin domain receptor tyrosine kinase 1
  ENST ID: ENST00000503495
  CDS Start-End: 48-636
agaaactctgtgagggttgtcagggacactgagaggtgggtgtgtgcatgccacatttagcctcgctgtttacagccagttcaagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctg

SEQ ID NO: 127214 - DNA, 460 bp, Homo sapiens
  Payload ID: 4905
  Gene Symbol: DDR1
  Gene Name: discoidin domain receptor tyrosine kinase 1
  ENST ID: ENST00000504679
  CDS Start-End: 94-460
gtgtttgctctgtctcagaaactctgtgagggttgtcagggacactgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttact

SEQ ID NO: 127215 - DNA, 604 bp, Homo sapiens
  Payload ID: 4905
  Gene Symbol: DDR1
  Gene Name: discoidin domain receptor tyrosine kinase 1
  ENST ID: ENST00000513043
  CDS Start-End: 451-604
cgttgggagcccaggggaatcagggcctgggcgtctggacccccgggtcccttagaacgcccttcagagagaggaactgagaggagaaggagaagagagtgggcccgccttcagggtctggggccttccaggttgggtcgtaggggcgggagcgcacaggctgcgagagaggagcaaaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagct

SEQ ID NO: 127216 - DNA, 1038 bp, Homo sapiens
  Payload ID: 4905
  Gene Symbol: DDR1
  Gene Name: discoidin domain receptor tyrosine kinase 1
  ENST ID: ENST00000484556
  CDS Start-End: 1-833
tgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtcagagtggaggagagggaagatgggtccgaggcgggggacagaaggggcagagttgtcatcttggagactaaagaatatttgttccctgactctcatccacactgccacaatgcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccat

SEQ ID NO: 127217 - DNA, 574 bp, Homo sapiens
  Payload ID: 4905
  Gene Symbol: DDR1
  Gene Name: discoidin domain receptor tyrosine kinase 1
  ENST ID: ENST00000502955
  CDS Start-End: 410-574
acttttcaaatgctactaaggaaagttagacatggaacttaatagttttcacaggtattcacgagtcctcaggagtccagagacctcagtttgagaacactatcctagcactgaccttgacttccagggtgaccttgagccaggctgctcagtccctctctgcgggggcctagaggctcggtgaggggagcgggacttggttgccatggtcacattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagat

SEQ ID NO: 127218 - DNA, 527 bp, Homo sapiens
  Payload ID: 4905
  Gene Symbol: DDR1
  Gene Name: discoidin domain receptor tyrosine kinase 1
  ENST ID: ENST00000503180
  CDS Start-End: 374-527
ggacaaagccaggcagcgttggcagccccagacccgaccccaaaggcctgagactggggtgactgggacctaagagaatcctgagctggagagctacgtcatctcaatctcctccttcgctccctggcctcagtttccagtttattcagtggcatcaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagct

SEQ ID NO: 127219 - DNA, 562 bp, Homo sapiens
  Payload ID: 4905
  Gene Symbol: DDR1
  Gene Name: discoidin domain receptor tyrosine kinase 1
  ENST ID: ENST00000507901
  CDS Start-End: 329-562
agtccagcgtctcctgggcctagattccccagctgctgttctctggaggggttcctggggcggagatgtgcagtggagcgagaacttcctgtgaccgtgacattgtctaggtggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcg

SEQ ID NO: 127220 - DNA, 571 bp, Homo sapiens
  Payload ID: 4905
  Gene Symbol: DDR1
  Gene Name: discoidin domain receptor tyrosine kinase 1
  ENST ID: ENST00000504651
  CDS Start-End: 353-571
ctcagccgttggaacgtccttgggcttctgaactagtgcccatgtgtgcctcggcctttcccaagggccagcttcttcctggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctgg

SEQ ID NO: 127221 - DNA, 547 bp, Homo sapiens
  Payload ID: 4905
  Gene Symbol: DDR1
  Gene Name: discoidin domain receptor tyrosine kinase 1
  ENST ID: ENST00000511510
  CDS Start-End: 120-547
agaagtaggaggggcgtcttcccctcgtgggccctgagcgggactgcagccagccccctggggcgccagctttggagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcagg

SEQ ID NO: 127222 - DNA, 573 bp, Homo sapiens
  Payload ID: 4905
  Gene Symbol: DDR1
  Gene Name: discoidin domain receptor tyrosine kinase 1
  ENST ID: ENST00000507046
  CDS Start-End: 364-573
agattccccagctgctgttctctggaggggttcctggggcggagatgtgcagtggagcgagaacttcctgtgaccgtgacattgtctaggtggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggat

SEQ ID NO: 127223 - DNA, 623 bp, Homo sapiens
  Payload ID: 4905
  Gene Symbol: DDR1
  Gene Name: discoidin domain receptor tyrosine kinase 1
  ENST ID: ENST00000512694
  CDS Start-End: 114-623
gcttttgtgtacttgtctggttgggacttcgtgtttctttcttgggattgttgtctgggactgcaagcaggagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggct

SEQ ID NO: 127224 - DNA, 1248 bp, Homo sapiens
  Payload ID: 4905
  Gene Symbol: DDR1
  Gene Name: discoidin domain receptor tyrosine kinase 1
  ENST ID: ENST00000460944
  CDS Start-End: 389-1248
aatgccgctttctgtttcctctgcctcccttcatctccttttgtctggggtttctttgtctggggtctccctttggttctgtttcacagttctcagcctcccctccctttctccacagccaggctgctcagtccctctctgcgggggcctagaggctcggtgaggggagcgggacttggttgccatggtcacattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactg

SEQ ID NO: 127225 - DNA, 570 bp, Homo sapiens
  Payload ID: 4905
  Gene Symbol: DDR1
  Gene Name: discoidin domain receptor tyrosine kinase 1
  ENST ID: ENST00000503628
  CDS Start-End: 104-211
acttgtctggttgggacttcgtgtttctttcttgggattgttgtctgggactgcaagcaggagatgctgcccccacccccttaggcccgagggatcaggagctatgggaccagaggccctgtcatctttactgctgctgctcttggtggcaagtggagatgctgacatgaagggacattttgatcctggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgct

SEQ ID NO: 127226 - DNA, 514 bp, Homo sapiens
  Payload ID: 4905
  Gene Symbol: DDR1
  Gene Name: discoidin domain receptor tyrosine kinase 1
  ENST ID: ENST00000514434
  CDS Start-End: 1-514
caacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaag

SEQ ID NO: 127227 - DNA, 538 bp, Homo sapiens
  Payload ID: 4905
  Gene Symbol: DDR1
  Gene Name: discoidin domain receptor tyrosine kinase 1
  ENST ID: ENST00000508317
  CDS Start-End: 159-538
acccgaccccaaaggcctgagactggggtgactgggacctaagagaatcctgagctggaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcg

SEQ ID NO: 127228 - DNA, 2882 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000513240
  CDS Start-End: 1-2760
atgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagag

SEQ ID NO: 127229 - DNA, 542 bp, Homo sapiens
  Payload ID: 4905
  Gene Symbol: DDR1
  Gene Name: discoidin domain receptor tyrosine kinase 1
  ENST ID: ENST00000504927
  CDS Start-End: 62-542
gagcgggactgcagccagccccctggggcgccagctttggaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttg

SEQ ID NO: 127230 - DNA, 3202 bp, Homo sapiens; identical to SEQ ID NO: 127180
  Payload ID: 4905
  Gene Symbol: DDR1
  Gene Name: discoidin domain receptor tyrosine kinase 1
  ENST ID: ENST00000548693
  CDS Start-End: 43-2346

SEQ ID NO: 127231 - DNA, 3781 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000550384
  CDS Start-End: 241-2925
agtgcggaggaactgagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127232 - DNA, 3781 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000548962
  CDS Start-End: 241-2925
agtgcggaggaactgagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127233 - DNA, 3857 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000553015
  CDS Start-End: 260-3001
tgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127234 - DNA, 3202 bp, Homo sapiens
  Payload ID: 4905
  Gene Symbol: DDR1
  Gene Name: discoidin domain receptor tyrosine kinase 1
  ENST ID: ENST00000550666
  CDS Start-End: 43-2346
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127235 - DNA, 3202 bp, Homo sapiens; identical to SEQ ID NO: 127180
  Payload ID: 4905
  Gene Symbol: DDR1
  Gene Name: discoidin domain receptor tyrosine kinase 1
  ENST ID: ENST00000552434
  CDS Start-End: 43-2346

SEQ ID NO: 127236 - DNA, 3857 bp, Homo sapiens; identical to SEQ ID NO: 127176
  Payload ID: 4905
  Gene Symbol: DDR1
  Gene Name: discoidin domain receptor tyrosine kinase 1
  Uniprot ID: Q08345
  ENST ID: ENST00000552068
  CDS Start-End: 260-3001

SEQ ID NO: 127237 - DNA, 3781 bp, Homo sapiens; identical to SEQ ID NO: 127231
  Payload ID: 4905
  Gene Symbol: DDR1
  Gene Name: discoidin domain receptor tyrosine kinase 1
  Uniprot ID: Q08345
  ENST ID: ENST00000549026
  CDS Start-End: 241-2925

SEQ ID NO: 127238 - DNA, 3857 bp, Homo sapiens; identical to SEQ ID NO: 127176
  Payload ID: 4905
  Gene Symbol: DDR1
  Gene Name: discoidin domain receptor tyrosine kinase 1
  Uniprot ID: Q08345
  ENST ID: ENST00000550395
  CDS Start-End: 260-3001

SEQ ID NO: 127239 - DNA, 3781 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000552721
  CDS Start-End: 241-2925
agtgcggaggaactgagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccgagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactctgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127240 - DNA, 3857 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000548133
  CDS Start-End: 260-3001
tgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggaccccaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagtgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127241 - DNA, 732 bp, Homo sapiens; identical to SEQ ID NO: 127122
  Payload ID: 4905
  Gene Symbol: DDR1
  Gene Name: discoidin domain receptor tyrosine kinase 1
  Uniprot ID: Q08345
  ENST ID: ENST00000617572
  CDS Start-End: 1-732

SEQ ID NO: 127242 - DNA, 732 bp, Homo sapiens; identical to SEQ ID NO: 127122
  Payload ID: 4905
  Gene Symbol: DDR1
  Gene Name: discoidin domain receptor tyrosine kinase 1
  Uniprot ID: Q08345
  ENST ID: ENST00000618059
  CDS Start-End: 1-732

SEQ ID NO: 127243 - DNA, 3202 bp, Homo sapiens
  Payload ID: 4905
  Gene Symbol: DDR1
  Gene Name: discoidin domain receptor tyrosine kinase 1
  ENST ID: ENST00000616404
  CDS Start-End: 43-2346
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactctgctccctgtgtccccaatggctctggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaagacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc

SEQ ID NO: 127244 - DNA, 732 bp, Homo sapiens
  Payload ID: 4905
  Gene Symbol: DDR1
  Gene Name: discoidin domain receptor tyrosine kinase 1
  Uniprot ID: Q08345
  ENST ID: ENST00000621544
  CDS Start-End: 1-732
atgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactccacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagtgtctgtctgcgggtagagctctatggctgcctctggagggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctga

SEQ ID NO: 127245 - DNA, 732 bp, Homo sapiens; identical to SEQ ID NO: 127122
  Payload ID: 4905
  Gene Symbol: DDR1
  Gene Name: discoidin domain receptor tyrosine kinase 1
  Uniprot ID: Q08345
  ENST ID: ENST00000620318
  CDS Start-End: 1-732

SEQ ID NO: 127246 - DNA, 3096 bp, Homo sapiens
  Payload ID: 4906
  Gene Symbol: DDR2
  Gene Name: discoidin domain receptor tyrosine kinase 2
  Uniprot ID: Q16832
  ENST ID: ENST00000367921
  CDS Start-End: 354-2921
catcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacact

SEQ ID NO: 127247 - DNA, 10160 bp, Homo sapiens
  Payload ID: 4906
  Gene Symbol: DDR2
  Gene Name: discoidin domain receptor tyrosine kinase 2
  Uniprot ID: Q16832
  ENST ID: ENST00000367922
  CDS Start-End: 439-3006
aaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatatgcctcccaggacccagagggagactgtagcctcatttctgtggagacctttggctggactctcctggctctcccagagactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatacacttttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgatatcttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtgtatttccccattcagctttcagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctggtcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcattagaattaaagggacttgaactcaggacctgcagcctattcttctttatccacatgtctctggtagggctacatccagatcacaccatgacttcttatagagcaagagaaaataatattattatatcttcctttgcctaaaatctctccacttattcttttttatgattctgcaccagttcactgggttattctatgattccatattttttttaaaaaaaatcatatttaaaatgaacttacaatgtctgaattttcctggccttgagtcacagaagtaatatgtttcagatggctgcccaatatgtattatcatgtaatacatatctgtgtccttttctgggatgaggaaggcttcaacttctggcactgagaactttgtattacagacacaggtttagtttctagcttagtcatgcctttagagtttagtagcacaaatccatgcaacccaacagaatacatggtgagggcctagtatgtagaatttgaaagtagttcaaatttgaattagaagaatgaagctaggacttatttggaaaaggagatagaaaaaaaatgatcagaaactgtggggccttattacctttgcagtaagttatcttcttcatgatatatgtgaattattttatgtgcagattgtgttttgggattgtcagatctaaacttatattcttgctggctaatgtgctgatagccaggtctgaaacttgatgtgctatccagacacatatgatcagaaaagatctagagtgcaaagaggtgcctgaggagcaaaatgtggttttaatgttgtggaaagatcacttgcaagtatataagactgtataaagaagaggactgtgtgcaagtggggtgaaaaaaaaggatacgtgaatgtgcatatgactgaatagggaggaaggtcagggctagaaaggaggctacataaaaaggggcaatggagaatgcacaggaaagacacaggggaaggtcaagtcgagcaaggtagaaacaggagtagctagagccattgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaagaaaggggaagttcctcttggaaaagatatagcaaccatcggggaatgaccttttcatttcagaagtggatgaggaaggtggtgtgagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaagtatgctgaaacagaacagtgaatgttttgcccaaaactacaaaaataaaagaaaaaaagaaaattgcaatacatggctactaagtctttgatcataagtcgaatttatagacctggaatttgccatcctagtctttcctttttagtaagacttctgtcctctggcagtgcatatggtaggtctctaatgtttcttcatctccaggaagatgcagatccttatttttgctgggaaatccttctaaatagaaatgtaacatttttataaaaacagattaatgtgtttttcacttagtaaatgttttcaagagctgaattgagaaggaaagagactggagtggttaatggtgatttgatttctggcattctgagttttctgctacaattagctgcattacttggtgccaaagagcagtggggaattgttgagttgctgtatcctttaaaaaaaaacaaaaaacttgttattttgaaagaacttaaggctcacaagatgttacaaaaatagtagagtggccttaccctagatccagttttccccatttataacatttcacttagtccattttcggaaccagaaaattaacattggcataatgctattaactaaactacagaccttttttcaatttcgccagtttttccacacatattcatttagttgctggatacttttaattcttgctgatttgtaaactggccttgcttggatacaacaggaaagatactatctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttcatagcttgttgtctagaaaaccaggtagcaggatattctagatgcttcctgctgcttctacgtgagtaggattagcactggggacaaaataaggagtttagagtaaaccagtatttcagtcaagagttagttggcacttagttaatggcactggaaatagcttgtggagagaatagaatacaatggtatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactgatggatctccctttctgtataaacagtgccagttctgggctttgtaacctttgctctttatagtctttcattcctggggaagtgatggggcatgggcccagagctggggtgtatgtggtatggacacctgtttgtggggctttccagcaaaggattatttaaatagacctctaacatatgagttgactgtttattgggaagaaagcatcttggtctctgacatatccaaacatacgagacactgggattttacgtcctcacattaattagtccagttctggggaatccagtctagaattaactggtgatcccttatcgttatggttacagacttgtcttgtttgatacacagaaatcctttttaaatccaaatatagtctgtctcagactacctgcacatgcacaaaccaaaaaaaactatgaaaaccagaatttagactcagtcattatactagagattagaatgaaacgaccccaaacaacccatttcttacctggtctctgagaataagtttatacttttagttttctgagaatatttctcagaatatgtgagttttctgagcacatttttcagcatggggtatggtagataaatcacagggccaaggtttggcagggatagatgggatcattgtgtaccctattgttcttctgatttccaggagaacagaatgagcccatgcaaaacataaacttatgatgattaaaaaaaacacacctatccattcactcatcaataaaaacatattatgatggttatcaagctgtgtcctatgagtgataaaatatttgtaaaatataaaattaaatggcatctattttgaa

SEQ ID NO: 127248 - DNA, 718 bp, Homo sapiens
  Payload ID: 4906
  Gene Symbol: DDR2
  Gene Name: discoidin domain receptor tyrosine kinase 2
  ENST ID: ENST00000415555
  CDS Start-End: 275-718
gctccgcgtgtgtgccccaactgtcctggaagcttcaattggaaaactccaaactttaagttttgcttatagcttcagctcaacctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctat

SEQ ID NO: 127249 - DNA, 693 bp, Homo sapiens
  Payload ID: 4906
  Gene Symbol: DDR2
  Gene Name: discoidin domain receptor tyrosine kinase 2
  ENST ID: ENST00000433757
  CDS Start-End: 1-514
catctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggtgagttgattctttgattcccttatagctcgaagaaggtggttggataaaaatgatcagtagaacaaagagtcccttccagaggtggattcacaacagaatgtctcttccatttgtctctccttgcattgtcctctggatttcagtattgggtcaacctaatctttgtcaaatagctgtggagttcc

SEQ ID NO: 127250 - DNA, 656 bp, Homo sapiens
  Payload ID: 4906
  Gene Symbol: DDR2
  Gene Name: discoidin domain receptor tyrosine kinase 2
  ENST ID: ENST00000446985
  CDS Start-End: 267-656
aaacagagaagagctggtgatagctccagagctcagagaaaggaggtctctttacaagaagtctggctctcaaagcctccatcaagggagacctgcaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatc

SEQ ID NO: 127251 - DNA, 558 bp, Homo sapiens
  Payload ID: 4906
  Gene Symbol: DDR2
  Gene Name: discoidin domain receptor tyrosine kinase 2
  ENST ID: ENST00000458105
  CDS Start-End: 1-501
cttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggtgtcaagggagaaacctcagcaagcatcaggtaggtatgacacgcctgctcccagttcattgcatctatttttagtctctgctaacctcctgagaagtccacattctctttctagatttggtctgccgctgctcctggcctaatttgagcaactctcctttgctactgaatataagatgtgtggagggacccacatacca

SEQ ID NO: 127252 - DNA, 1979 bp, Homo sapiens
  Payload ID: 4907
  Gene Symbol: DCBLD1
  Gene Name: discoidin, CUB and LCCL domain containing 1
  Uniprot ID: Q8N8Z6
  ENST ID: ENST00000296955
  CDS Start-End: 126-1745
ggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcaggttaactccgttgactgccaaaatagcatccccaacgtgcagccctccgcatctatcagcaggttgccccggatggatctcagagatgaggattggaacaccatgttctttcccaccctaacaacaacaaagggcagtaaattaaagtactctttgtaaggtacagttaccgattaatctagagataaaatattttcttaaaaatatatttcattaaacacctatgctgtctctataaa

SEQ ID NO: 127253 - DNA, 3626 bp, Homo sapiens
  Payload ID: 4907
  Gene Symbol: DCBLD1
  Gene Name: discoidin, CUB and LCCL domain containing 1
  Uniprot ID: Q8N8Z6
  ENST ID: ENST00000338728
  CDS Start-End: 121-2268
cgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgatggctgtggacacctagtgacttatcaggatagtggcacaatgacatctaagaattatcccgggacctaccccaatcacactgtttgcgaaaagacaattacagtaccaaaggggaaaagactgattctgaggttgggagatttggatatcgaatcccagacctgtgcttctgactatcttctcttcaccagctcttcagatcaatatggtccatactgtggaagtatgactgttcccaaagaactcttgttgaacacaagtgaagtaaccgtccgctttgagagtggatcccacatttctggccggggttttttgctgacctatgcgagcagcgaccatccagatttaataacatgtttggaacgagctagccattatttgaagacagaatacagcaaattctgcccagctggttgtagagacgtagcaggagacatttctgggaatatggtagatggatatagagatacctctttattgtgcaaagctgccatccatgcaggaataattgctgatgaactaggtggccagatcagtgtgcttcagcgcaaagggatcagtcgatatgaagggattctggccaatggtgttctttcgagggatggttccctgtcagacaagcgatttctgtttacctccaatggttgcagcagatccttgagttttgaacctgacgggcaaatcagagcttcttcctcatggcagtcggtcaatgagagtggagaccaagttcactggtctcctggccaagcccgacttcaggaccaaggcccatcatgggcttcgggcgacagtagcaacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtgtttcagggtaactctaactttcgggacccagtgcaaaacaatttcatccctcccatcgtggccagatatgtgcgggttgtcccccagacatggcaccagaggatagccttgaaggtggagctcattggttgccagattacacaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgattggcaccgggacagtcacgaggaagggctccaccttccggcccatggacacggatgccgaggaggcaggggtgagcaccgatgccggcggccactatgactgcccgcagcgggccggccgccacgagtacgcgctgcccctggcgcccccggagcccgagtacgccacgcccatcgtggagcggcacgtgctgcgcgcccacacgttctctgcgcagagcggctaccgcgtcccagggccccagcccggccacaaacactccctctcctcgggcggcttctcccccgtagcgggtgtgggcgcccaggacggagactatcaaaggccacacagcgcacagcctgcggacaggggctacgaccggcccaaagctgtcagcgccctcgccaccgaaagcgggcaccctgactctcagaagcccccaacgcatcccgggacgagtgacagctattctgcccccagagactgcctcacacccctcaaccagacggccatgactgcccttttgtgaacacaatgtgaaagaagcctgctgtggtactgagcgtcgggctgtcacaaggcactggaagaagggagcctgctggtccagagtgtgcgtgtgtatcggtgtgtgtgtacacttgcatgtgtgtgtgtgatccagtaggatcctagagacaacctgtcatactgtttacaaaattgtgcagctggtttcgtgctgacccttagggtgcgtctgttgggttttgttgggctagaaaaatgaaaattttcagatggcgttttcattcctctgactgatattgagctgctttggtgttaaaggtgtaatgtgtacagagttgtatttaacaataataaaagtaacttaagtttgctctatcagattttagttctgcacagaggttaagtgggaaaatgcagctgttgcaaaatgtatataaatagtatgttcatttttttcagtatattatctgatactgtgttagcagcaggtctgcttaaacctagtcttgttgttattgagtcatttcctctcctttgataactagaactgaaagcatttttaacattcttctcctggaagaaatgaattacttgaagcatgaaaagcacaccagggtggttgtttatttagcaattatgactgtagatttaaaaacaagcaaagaaacaacacctcagcagctgcccgtttccttagtctccacttcagagggggatgcgaagaggtcggcccagctccggtgaccatgaaggtggcacaggaattacagtgtgaatggctgtgtcagatgttttcgtacctcagattaaaaatattgctgaggtcagacgccacaattttcatgactttcttcagaagtagcacattttcgtgacttccgctgtcctctgaaaaacaaagttatttggaacatgttcatgcaaaagtgattctgaccaagtctaaatcgagcttttctactgacatgaaactgttggaaactgatctcattttataagaaatgattttcccctcaaggaggcgtctgtaattccagaacagtccagacatcagctgtacctcatgctcagtagtttttatttgagtttcttttgtgagttaactatgggagatttaacctcttttgccaaagagggaagtgtgtgtgtttttttaatagaaaatatggaccaaaaatttttttccctgaagaatgtattataaccctatttgtgtggttattacatcctgtgaaatgtatatatgttaaaataatgggggtgctggaaggtcatggcagactagctgctggttagtgtggaggggaaatggtttactttgtagagtttacatggttttatgcgcacactaattgtaataaactatgccaaaccaaa

SEQ ID NO: 127254 - DNA, 574 bp, Homo sapiens
  Payload ID: 4907
  Gene Symbol: DCBLD1
  Gene Name: discoidin, CUB and LCCL domain containing 1
  ENST ID: ENST00000424717
  CDS Start-End: 1-300
aacaaccacaaaccacgagagtggctggagatcgatttgggggagaaaaagaaaataacaggaattaggaccacaggatctacacagtcgaacttcaacttttatgttaagagttttgtgatgaacttcaaaaacaataattctaagtggaagacctataaaggaattgtgaataatgaagaaaaggtaatgattcattggtgtggcgcaagacaagtcaaagcaccagtgtttcaactaagaaagaagatgagacaatcacaaggcccatcccctcggaagaaacatccacaggaataaacattacaacggtggctattccattggtgctccttgttgtcctggtgtttgctggaatggggatctttgcagcctttagaaagaagaagaagaaaggaagtccgtatggatcagcagaggctcagaaaacagactgttggaagcagattaaatatccctttgccagacatcagtcagctgagtttaccatcagctatgataatgagaaggagatgacacaaaagttagatctcatcacaagtgatatggcagattaccagcagcccctcatgat

SEQ ID NO: 127255 - DNA, 6122 bp, Homo sapiens
  Payload ID: 4908
  Gene Symbol: DCBLD2
  Gene Name: discoidin, CUB and LCCL domain containing 2
  Uniprot ID: Q96PD2
  ENST ID: ENST00000326840
  CDS Start-End: 364-2691
gcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtctcggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactataaaatgccagattcttctattttaacctca

SEQ ID NO: 127256 - DNA, 3959 bp, Homo sapiens
  Payload ID: 4908
  Gene Symbol: DCBLD2
  Gene Name: discoidin, CUB and LCCL domain containing 2
  Uniprot ID: Q96PD2
  ENST ID: ENST00000326857
  CDS Start-End: 1-2370
atggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagta

SEQ ID NO: 127257 - DNA, 554 bp, Homo sapiens
  Payload ID: 4908
  Gene Symbol: DCBLD2
  Gene Name: discoidin, CUB and LCCL domain containing 2
  ENST ID: ENST00000449482
  CDS Start-End: 229-554
gctcttacttgtcctgctcctgctgctcgaggacgctggagcccagcaagttatggaggctagaattctgacagcagggtgtgcagagggccatgctctttcctaagactctaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaaggtaattttcaccttttgcaatggttcctacagtttgtaatttctaacaacaaaaataaaatgctttttttaag

SEQ ID NO: 127258 - DNA, 7023 bp, Homo sapiens
  Payload ID: 4909
  Gene Symbol: DIP2A
  Gene Name: disco-interacting protein 2 homolog A
  Uniprot ID: Q14689
  ENST ID: ENST00000400274
  CDS Start-End: 234-4937
ccggccgggcgctcaggagcgcgcggggcagcggcggcgcggcggagccatccgcgctcgtgcccgcgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaa

SEQ ID NO: 127259 - DNA, 6967 bp, Homo sapiens
  Payload ID: 4909
  Gene Symbol: DIP2A
  Gene Name: disco-interacting protein 2 homolog A
  Uniprot ID: Q14689
  ENST ID: ENST00000417564
  CDS Start-End: 22-4737
cggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaa

SEQ ID NO: 127260 - DNA, 3044 bp, Homo sapiens
  Payload ID: 4909
  Gene Symbol: DIP2A
  Gene Name: disco-interacting protein 2 homolog A
  Uniprot ID: Q14689
  ENST ID: ENST00000457905
  CDS Start-End: 183-2852
ccgcgctcgtgcccgcgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggtgggcgccccggcacggcctatggttcggtgaatctcccaagctggcacccccactccactccaagtgccaagtggttggcttgtcccgcccggtcctccctggctccagctttgtttatctgtatttttcattgcaaattgacaaattacagctgtatgtatttacgggatacaaagtgatgttataatttatgaatacaatatagaataattaatatatcca

SEQ ID NO: 127261 - DNA, 2760 bp, Homo sapiens
  Payload ID: 4909
  Gene Symbol: DIP2A
  Gene Name: disco-interacting protein 2 homolog A
  Uniprot ID: Q14689
  ENST ID: ENST00000435722
  CDS Start-End: 76-2601
gtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaat

SEQ ID NO: 127262 - DNA, 2711 bp, Homo sapiens
  Payload ID: 4909
  Gene Symbol: DIP2A
  Gene Name: disco-interacting protein 2 homolog A
  Uniprot ID: Q14689
  ENST ID: ENST00000466639
  CDS Start-End: 156-2552
gctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacataggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaat

SEQ ID NO: 127263 - DNA, 8593 bp, Homo sapiens
  Payload ID: 4910
  Gene Symbol: DIP2B
  Gene Name: disco-interacting protein 2 homolog B
  Uniprot ID: Q9P265
  ENST ID: ENST00000301180
  CDS Start-End: 35-4765
tcttgtcttccggagtgtggctggcggagctgggatggcggaacgaggcctggagccgtcgccggccgcggtggcggcgctgccgcctgaagtgcgggcgcagctggcggagctggagctggagctctcggagggggacatcacccagaagggctatgaaaagaaaaggtccaaactcctatctccttacagcccgcagacacaagaaactgattcagcagtacagaaagaacttagaaaccagacacctgctccatctgcagctcaaacttctgctccctctaagtaccaccgaactcgatctgggggagccagggatgaacgatatcgatcagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggaaagttgtggagcagaagtttaaagttggcctacacacttcttaataaactggggaccaaaaatgaacctgtgttaaaacctggagacagggtagccctggtttaccccaacaatgatccagtcatgtttatggtggctttctatggatgcctcctggcagaagtgattccagtgcctatagaggtacctcttaccagaaaggatgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgagtataaaacaagcaaagaagggagtgtaatgggagttacagtatcccggcttgcaatgttgtctcactgccaagctctgtcgcaggcctgcaattattctgaaggggaaacaatagtaaatgtcttagactttaagaaggatgctgggctgtggcacggcatgtttgcgaatgtaatgaataagatgcacacaatcagcgtaccctactctgttatgaaaacctgtcctctctcttgggtccaaagagtacatgctcacaaagccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaattgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctaagagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttcatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacaagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaa

SEQ ID NO: 127264 - DNA, 3514 bp, Homo sapiens
  Payload ID: 4910
  Gene Symbol: DIP2B
  Gene Name: disco-interacting protein 2 homolog B
  ENST ID: ENST00000546732
  CDS Start-End: 1-193
agctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgaggggaaacaatagtaaatgtcttagactttaagaaggatgctgggctgtggcacggcatgtttgcgaatgtaatgaataagatgcacacaatcagcgtaccctactctgttatgaaaacctgtcctctctcttgggtccaaagagtacatgctcacaaagccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaattgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctaagagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgc

SEQ ID NO: 127265 - DNA, 7888 bp, Homo sapiens
  Payload ID: 4911
  Gene Symbol: DIP2C
  Gene Name: disco-interacting protein 2 homolog C
  Uniprot ID: Q9Y2E4
  ENST ID: ENST00000280886
  CDS Start-End: 91-4761
ctcggtgcggttccgccgggcgcgaggagccgccgagacctccgcctgcgaacaaagaggaggccgtgcggggcgcggcgcccgcggagcatggcggaccgcagcctggagggcatggcgctgcccctggaggtgcgggcgcgcctggccgagctggagctggagctgtcggaaggtgacatcacacaaaaaggatatgaaaagaagaggtcaaagttaattggagcctaccttccgcagcctccgagggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccgctcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaaagtggcacatttaaaaaaatgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcacattt

SEQ ID NO: 127266 - DNA, 7749 bp, Homo sapiens
  Payload ID: 4911
  Gene Symbol: DIP2C
  Gene Name: disco-interacting protein 2 homolog C
  ENST ID: ENST00000381496
  CDS Start-End: 1-4614
actgaacttcattttccttctcttgcaggtgacatcacacaaaaaggatatgaaaagaagaggtcaaagttaattggagcctaccttccgcagcctccgagggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccgctcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgttaaaaaaaaaaaaaaaaaaaaagtggcacatttaaaaaaatgtgtctgcatatgtggtgcatccttccatctccacaaaccatttgattcttgaaatattgtttgacctcattgctgtgtgtgaatatttctccacatgcttcagatgcacattcctagtctctgcttcctaaggggggaaccaccacacattggggggaaaaaagacattttcctacacccacccaccttgttgaaagggaggtaggtttggggcttcaggccaggcactgactatgaaacattagctgcagtgtgcaggacagctttgaggtccagctgaagtcaggaagcaaaacaaatgtagatgtcacttcaaacataatttcaactgtcaccagatcaactctacattcaaggagtgtggacgctgcagtgcagttgtgagggcagttagcagccgcctcttctgcatcctgtcaactctgattagttagagtttaggctcaaaagagttggtggactgagattgaaatttggttgtgcaagagaaaggaaaggagacacttagtaccaccagtttcagcaataaagaagggtcattctgtattcaaaattgtactgtagataaatcattcatgagattgtaaaaaatgtttgtcttgtgaccttgtgcttttgaagtcagacaaaaccgtgtaatcaacttgcacaaaaagagggtacacagtgaacatataaacacagacctaatcaaacaggagcagattcctcatggtgcttgtttattatatatatttaatcctgcttgacactttacccaagggagatggtcccttttatcagttgaatgttagcagcgttatttcagagtgtggtgactggttagagaaactcatgtactcaaccagccacagtttcaaacaaaatttttatgtgcaaaggacagcaaccttcttgtatgttaaaccaccagtacgctttgtacatctgtgataacgcctgttttatattcaaatgaacaaataaaagcttttatttttgttgctctgaaaatagcagtttcttaattggtcccctggaaagatgtctgggacagctttaatcccgggaaggaagtgactcctacagggaaatgtatctgactctgtttacataatttgttgcattacttagtacagataatcatactttgaaaaatgtttaaattttgatgtgggcatttattgctaaaaataattcctatggcaacaaatgttttgtgaaatgttttttttaattcttttaaatatatctaaatatatttgttcacattttgctgcaa

SEQ ID NO: 127267 - DNA, 757 bp, Homo sapiens
  Payload ID: 4911
  Gene Symbol: DIP2C
  Gene Name: disco-interacting protein 2 homolog C
  ENST ID: ENST00000421992
  CDS Start-End: 1-721
gacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgagcatacttccaacaagggcaaataacattttatgaatgaagagagattactttaaaactaa

SEQ ID NO: 127268 - DNA, 646 bp, Homo sapiens
  Payload ID: 4911
  Gene Symbol: DIP2C
  Gene Name: disco-interacting protein 2 homolog C
  ENST ID: ENST00000434695
  CDS Start-End: 1-391
cgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagtgctgggattacaggcatgagccaccacgcccagccccaaaatgttttaagatggtttacaaggaaggagtacgctcagtaggagaagataaaatacgtgaaaaaagaaccaaaacatggagatgaaagaaaaacagcgcaggaaagggacagaatgaagaacagagttggcgtgctggtgttttccacaaggcttctgaagcgtgccaccgtccttacctcggcaccagggcggggcctgacacgtggtggatattgaatgaatgtgcgccgtgggagtgttgagcacggttctgtattcttaataggaaatggcaatatgttcttgtgcagaagacaattctgtcaatatgaccgctaaatcaaaattcagtattctaa

SEQ ID NO: 127269 - DNA, 4961 bp, Homo sapiens
  Payload ID: 4911
  Gene Symbol: DIP2C
  Gene Name: disco-interacting protein 2 homolog C
  ENST ID: ENST00000634311
  CDS Start-End: 91-4959
ctcggtgcggttccgccgggcgcgaggagccgccgagacctccgcctgcgaacaaagaggaggccgtgcggggcgcggcgcccgcggagcatggcggaccgcagcctggagggcatggcgctgcccctggaggtgcgggcgcgcctggccgagctggagctggagctgtcggaaggtgacatcacacaaaaaggatatgaaaagaagaggtcaaagttaattggagcctaccttccgcagcctccgacagcgaatggagctgccgtggttcggtgtagactgcagcacagtgaaggagcgccgaggagaacattccgctctgcccacatcggggtgtgcgacgtccgagaagctgcggctcgggagcgggtggccagcaccgcagggaaccggcctctgttttactttcgtttcggggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccgctcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagcctcacaggctgtggaccctggccgagcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtc

SEQ ID NO: 127270 - DNA, 6683 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000315677
  CDS Start-End: 597-3530
attaacatgcacccaggggcgggtcaccagcccagccttgcagccccagcccgccgcgtcccggcgctcagcctccgctccagaggcgagcgctgcgcttcgggcgccgcaatctccaggacacggcctcgcggacaccttccgcctcggggaatcggcagcataggcggcgcgaacggccgccgccgcctcggctcctctctcgagtccttcccgtcacctcgctgagagccggtcctggtcgcggggacatctctctccttcctccgaggctcgtgggaccaacggacggacgcagccagcgagggccggactgcgggacgcggccagagcagttgaacatcagatacccagagtgacatcaggttaaaaaaaagcctgcaatttggatcttttcctgactcggaagcaaggaaaatggacaattgataatcaaaggctaaatctcttctgggatccactgaatgccactagagggtctgctcgagagaattcctgattgaatgacaacggcgctaagaacaatccctgcccaagacgggtctggagcctgacttccgggtgtccatgaccctggcggctgcttccggtccgccatgaaagggctatcaggcagccgcagccatcaccacggggtcacctgcgactcggcctgtgactcgctgtcgcaccactccgaccgcaagccctacctgctgagcccagtggagcaccaccccgcagaccacccatactacacccagcggaactccttccaggctgagtgcgtgggccccttcagcgacccgctggccagcagcaccttcccccgcaggcactacacctcgcagcaagagctgaaggacgagtgtgccctggtgccccgcaccctggccaccaaggcgaaccgcatccccgccaacctgctggaccagttcgagcggcagctgccactcagccgcgatggctatcacaccctgcagtacaagcgcacggccgtggagcaccgcagcgacagccccggccgcatccgccacctggtgcactcggtccagaagctcttcaccaagtcgcactccctggaggggccgtccaagggcagcgtcaacgggggcaaggccagccctgacgaggcgcaggcggcgcgctatggcaaacgcagcaagagcaaggagcggcgcgcggagcccaaggcccggcccagcacctccccgggctggtggagctcggacgacaacctggatggtgacatgtgcatctaccacgccccctcgggcgtgatgaccatgggcaggtgccccgaccgctcggcctcacagtacttcctggaggcctacaacaccatcagcgagcaggcggtgaaggcctcccggagcaacaacgacgtcaagtgctccacctgcgccaacctgccggtcagcctggacaccccgctgctgaagaagagcgcctggtcctccacgctcaccgtgagccgggcccgggaggtttaccagaaggcctcggtgaacatggaccaggccatggtgaagtccgagtcgtgtcagcaagaacgctcctgccagtacctgcaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 127271 - DNA, 2188 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000400145
  CDS Start-End: 15-1898
agctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccattttagtcactggaaggaactgcctccattttgctttttaaactaaaataaatgacatcttcagtgcatgaatccatagaacaaga

SEQ ID NO: 127272 - DNA, 5258 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000400147
  CDS Start-End: 78-2105
cacttagaatcggcaaatcatagagagaagctaaatgctctcagctgcactataccaaatcaaagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 127273 - DNA, 5203 bp, Homo sapiens
  Payload ID: 4912
  Gene Symbol: DLGAP1
  Gene Name: discs, large (Drosophila) homolog-associated protein 1
  ENST ID: ENST00000400149
  CDS Start-End: 47-2050
accgagaaggaaagcactcccagagatgaaattttaggaaagcaaaatgatcgacctttttaaggctgagtgggtttcttcagtttgtgtgcaagtttcaagaaatggaaggactgaccaggtttgggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacgggtgtcataaaactgagttctgcagttgaagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 127274 - DNA, 5332 bp, Homo sapiens
  Payload ID: 4912
  Gene Symbol: DLGAP1
  Gene Name: discs, large (Drosophila) homolog-associated protein 1
  ENST ID: ENST00000400150
  CDS Start-End: 98-2179
ggtagaagtggagagagagagacagagggagcgagagagagagcaagacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacgggtgtcataaaactgagttctgcagttgaagtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 127275 - DNA, 5257 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000400155
  CDS Start-End: 53-2104
agacagaccgagaaggaaagcactcccagagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 127276 - DNA, 2365 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000534970
  CDS Start-End: 62-2047
gctgtttagaactattgtaccgctgccagtgactgtctgtattagggttgggagcaggaacatggatttgaagacattaaaactgtttaattctcagttgagatgtggttggctcttatacatttggaataaagcatttatggcacatctcagggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttag

SEQ ID NO: 127277 - DNA, 5314 bp, Homo sapiens
  Payload ID: 4912
  Gene Symbol: DLGAP1
  Gene Name: discs, large (Drosophila) homolog-associated protein 1
  ENST ID: ENST00000515196
  CDS Start-End: 62-2161
gctgtttagaactattgtaccgctgccagtgactgtctgtattagggttgggagcaggaacatggatttgaagacattaaaactgtttaattctcagttgagatgtggttggctcttatacatttggaataaagcatttatggcacatctcagggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacgggtgtcataaaactgagttctgcagttgaagtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 127278 - DNA, 2402 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000539435
  CDS Start-End: 77-2134
acttagaatcggcaaatcatagagagaagctaaatgctctcagctgcactataccaaatcaaagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacgggtgtcataaaactgagttctgcagttgaagtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccct

SEQ ID NO: 127279 - DNA, 2258 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000581699
  CDS Start-End: 26-2077
agagatgaaattttaggaaagcaaaatgatcgacctttttaaggctgagtgggtttcttcagtttgtgtgcaagtttcaagaaatggaaggactgaccaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttc

SEQ ID NO: 127280 - DNA, 6356 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000584874
  CDS Start-End: 270-3203
cagagcagttgaacatcagatacccagagtgacatcaggttaaaaaaaagcctgcaatttggatcttttcctgactcggaagcaaggaaaatggacaattgataatcaaaggctaaatctcttctgggatccactgaatgccactagagggtctgctcgagagaattcctgattgaatgacaacggcgctaagaacaatccctgcccaagacgggtctggagcctgacttccgggtgtccatgaccctggcggctgcttccggtccgccatgaaagggctatcaggcagccgcagccatcaccacggggtcacctgcgactcggcctgtgactcgctgtcgcaccactccgaccgcaagccctacctgctgagcccagtggagcaccaccccgcagaccacccatactacacccagcggaactccttccaggctgagtgcgtgggccccttcagcgacccgctggccagcagcaccttcccccgcaggcactacacctcgcagcaagagctgaaggacgagtgtgccctggtgccccgcaccctggccaccaaggcgaaccgcatccccgccaacctgctggaccagttcgagcggcagctgccactcagccgcgatggctatcacaccctgcagtacaagcgcacggccgtggagcaccgcagcgacagccccggccgcatccgccacctggtgcactcggtccagaagctcttcaccaagtcgcactccctggaggggccgtccaagggcagcgtcaacgggggcaaggccagccctgacgaggcgcaggcggcgcgctatggcaaacgcagcaagagcaaggagcggcgcgcggagcccaaggcccggcccagcacctccccgggctggtggagctcggacgacaacctggatggtgacatgtgcatctaccacgccccctcgggcgtgatgaccatgggcaggtgccccgaccgctcggcctcacagtacttcctggaggcctacaacaccatcagcgagcaggcggtgaaggcctcccggagcaacaacgacgtcaagtgctccacctgcgccaacctgccggtcagcctggacaccccgctgctgaagaagagcgcctggtcctccacgctcaccgtgagccgggcccgggaggtttaccagaaggcctcggtgaacatggaccaggccatggtgaagtccgagtcgtgtcagcaagaacgctcctgccagtacctgcaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggagagaagggcccctcctccagtgccaaagaagccggcgaagggccccgcgccgctgatccgggagcgctcgctggagagctcgcagcgccaggaggcccgcaagcgcctgatggccgccaagcgcgccgcgtccgtccgccagaactcggccaccgagagcgccgagagcatcgagatctacatccccgaggcgcagacccggctctgagcgccccgcagcccggccgccgccgccaagcatctgtcccctcctcccccggccgctcctctgccggctgcctctccccctccgagcccgtccgctcccgagctcggtgacttccactgtcgcggtgtagttgtccacctcgcaggagccgccccccgggcccccctcagccccccacttcccgtacccgtttgcccatctccttcttcaccgagcttcgccccctgtcctgatgccgtcgccctgcctcatactgagatccaaccctttattttctgggcaaagccaaacccacctgtgtagaagtgatgcctttaggtcacccgccgtcctcagttctctcgagctagtctgttcagcaatataaaaccatagggtatttcagaaatccagtatcacagggtgatcctttgggacttaccgtcttccacgtgaaagaaactaggcctccgattccctttatttcccctaaatggttattcttttaaaaaagcagatggagcactttattcccaacctcagaaatcacaccatctcactggaatccatgagggacacagagagaggggaccaagcctggcctgggggtgggggacctggatgtgtagcaaggatgggagaagcgaaatctgcaggtgctgggggcacctgcacactcacagctgcacaaactgcctcactgttacttcatcaatcacagcttcaaatgtctcaatcagcagaagattgtaaattcgatctttcagggaaattaatctattctgaaaggcaataacatgaagcaaggcaaaggaggcactgatggtttagtatactacataagggatttttttgttctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcgtatttcagatatattttctcctttcatctcctctcactactgcagagtccagtaatacctagcataggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttagtcttgattgatgggcagtatgcatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgct

SEQ ID NO: 127281 - DNA, 3525 bp, Homo sapiens
  Payload ID: 4912
  Gene Symbol: DLGAP1
  Gene Name: discs, large (Drosophila) homolog-associated protein 1
  Uniprot ID: O14490
  ENST ID: ENST00000581527
  CDS Start-End: 528-3317
agcctccgctccagaggcgagcgctgcgcttcgggcgccgcaatctccaggacacggcctcgcggacaccttccgcctcggggaatcggcagcataggcggcgcgaacggccgccgccgcctcggctcctctctcgagtccttcccgtcacctcgctgagagccggtcctggtcgcggggacatctctctccttcctccgaggctcgtgggaccaacggacggacgcagccagcgagggccggactgcgggacgcggccagagcagttgaacatcagatacccagagtgacatcaggttaaaaaaaagcctgcaatttggatcttttcctgactcggaagcaaggaaaatggacaattgataatcaaaggctaaatctcttctgggatccactgaatgccactagagggtctgctcgagagaattcctgattgaatgacaacggcgctaagaacaatccctgcccaagacgggtctggagcctgacttccgggtgtccatgaccctggcggctgcttccggtccgccatgaaagggctatcaggcagccgcagccatcaccacggggtcacctgcgactcggcctgtgactcgctgtcgcaccactccgaccgcaagccctacctgctgagcccagtggagcaccaccccgcagaccacccatactacacccagcggaactccttccaggctgagtgcgtgggccccttcagcgacccgctggccagcagcaccttcccccgcaggcactacacctcgcagcaagagctgaaggacgagtgtgccctggtgccccgcaccctggccaccaaggcgaaccgcatccccgccaacctgctggaccagttcgagcggcagctgccactcagccgcgatggctatcacaccctgcagtacaagcgcacggccgtggagcaccgcagcgacagccccggccgcatccgccacctggtgcactcggtccagaagctcttcaccaagtcgcactccctggaggggccgtccaagggcagcgtcaacgggggcaaggccagccctgacgaggcgcaggcggcgcgctatggcaaacgcagcaagagcaaggagcggcgcgcggagcccaaggcccggcccagcacctccccgggctggtggagctcggacgacaacctggatggtgacatgtgcatctaccacgccccctcgggcgtgatgaccatgggcaggtgccccgaccgctcggcctcacagtacttcctggaggcctacaacaccatcagcgagcaggcggtgaaggcctcccggagcaacaacgacgtcaagtgctccacctgcgccaacctgccggtcagcctggacaccccgctgctgaagaagagcgcctggtcctccacgctcaccgtgagccgggcccgggaggtttaccagaaggcctcggtgaacatggaccaggccatggtgaagtccgagtcgtgtcagcaagaacgctcctgccagtacctgcaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggaccctgcaggcttgctcacatcaccaaagttccgctccaggaatgagagctacatgcgagccatgagcaccatcagccaggtgagcgagatggaagtgaacgggcagttcgagtccgtgtgcgagtccgtgttcagcgagctggagtcgcaggccgtggaagcgctggacctgcccatgcccggctgcttccgcatgcggagccacagctatgtgcgggccattgagaaaggctgctcccaggacgacgagtgcgtgtccctgaggtcgtcctcgccgccgcgcaccaccaccaccgttaggaccatccagagcagcacggtgtcatcttgcattacaacatataagaagacaccacctccagtcccacccagaactaccacgaaacctttcatttctatcacagcccagagtagcacagagtcagcccaggatgcctacatggacggacagggccagcgaggagatattatcagccagtctggactcagcaactccaccgagagcctggacagtatgaaggctctgacagccgccatcgaagctgcaaacgcccagatccatggccctgccagtcaacacatgggcaataacactgccaccgtcaccaccacgactaccatagccaccgtcaccacggaggacaggaagaaggaccactttaagaaaaatcgatgcctgtctatcgggatacaggtggatgatgctgaagaacctgacaaaacaggggagaataaagcacccagtaagttccagtccgtgggagtgcaagtagaagaagagaagtgcttccgcaggttcactcgatccaacagtgtgacgacagcagtacaggccgacctggacttccatgataatctggaaaattctctggaatctatagaggacaattcgtgtcctggccccatggccagacagttctcccgcgatgccagcacctccacagtcagcattcagggctcaggaaaccattaccatgcctgtgccgccgatgatgactttgacacggattttgacccctctattctgcctcctccggacccctggattgactctatcactgaagaccctctggaggccgtgcaaaggtcagtgtgccaccgggatggccactggttcctgaagcttctccaggcagagcgagaccgcatggaggggtggtgtcaacagatggagcgggaagaacgggaaaacaacctgcccgaagacattctaggaaaaatccgaaccgcagtgggcagtgcccaacttctcatggcccagaaattctaccagttcagagaactgtgtgaagaaaacctgaatcctaatgctcatccaagacccacctcccaggatttggcggggttttgggacatgctgcagttgtccatagaaaatattagtatgaaatttgatgaacttcatcagttaaaggccaataattggaaacagatggatcctcttgacaagaaggtagaacaatgtagattttgtatggttcatttaaaaacctgcacaaacactggacagtctaaataggcttctgcattcagtcctgctgtttacaatgtgaaatggagctgatatcatattaatttcattgtaatgacaatgtttacatagtaatcatttgggatattatctgtaatatgtttcaggcatatttttaaagaaaaacctgtctttgtgaattggaaaatgggaatgtggctttttttgttaattaaactttaagttaaaccatttt

SEQ ID NO: 127282 - DNA, 10132 bp, Homo sapiens
  Payload ID: 4913
  Gene Symbol: DLGAP2
  Gene Name: discs, large (Drosophila) homolog-associated protein 2
  Uniprot ID: Q9P1A6
  ENST ID: ENST00000421627
  CDS Start-End: 135-3062
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttaa

SEQ ID NO: 127283 - DNA, 3515 bp, Homo sapiens
  Payload ID: 4913
  Gene Symbol: DLGAP2
  Gene Name: discs, large (Drosophila) homolog-associated protein 2
  ENST ID: ENST00000520901
  CDS Start-End: 51-2936
cgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtc

SEQ ID NO: 127284 - DNA, 10130 bp, Homo sapiens
  Payload ID: 4913
  Gene Symbol: DLGAP2
  Gene Name: discs, large (Drosophila) homolog-associated protein 2
  ENST ID: ENST00000620101
  CDS Start-End: 135-3062
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctacaagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagtt

SEQ ID NO: 127285 - DNA, 10088 bp, Homo sapiens
  Payload ID: 4913
  Gene Symbol: DLGAP2
  Gene Name: discs, large (Drosophila) homolog-associated protein 2
  ENST ID: ENST00000620226
  CDS Start-End: 135-3020
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctacaagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagtt

SEQ ID NO: 127286 - DNA, 10088 bp, Homo sapiens
  Payload ID: 4913
  Gene Symbol: DLGAP2
  Gene Name: discs, large (Drosophila) homolog-associated protein 2
  ENST ID: ENST00000612087
  CDS Start-End: 135-3020
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcgccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttttctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagtt

SEQ ID NO: 127287 - DNA, 632 bp, Homo sapiens
  Payload ID: 4913
  Gene Symbol: DLGAP2
  Gene Name: discs, large (Drosophila) homolog-associated protein 2
  ENST ID: ENST00000633079
  CDS Start-End: 1-530
aaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaagtaagagctcaggcttccctagggcctcttaaatatcatttctcagtaatgcaaatatgcacatcacagcattagtggagaaaagttcctccctttggtattcaagtgaagggaaataaatgtgctttctagta

SEQ ID NO: 127288 - DNA, 1336 bp, Homo sapiens
  Payload ID: 4913
  Gene Symbol: DLGAP2
  Gene Name: discs, large (Drosophila) homolog-associated protein 2
  ENST ID: ENST00000633655
  CDS Start-End: 135-1336
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagac

SEQ ID NO: 127289 - DNA, 615 bp, Homo sapiens
  Payload ID: 4913
  Gene Symbol: DLGAP2
  Gene Name: discs, large (Drosophila) homolog-associated protein 2
  ENST ID: ENST00000632589
  CDS Start-End: 1-477
agcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaaaattgttaccagctcatgctttacaagaaaatgccttggcattatgccaaagagaagtcgatggaggtgacgatggacgccgaatgttggggagatgctgccttccacgtgacccacagtccccgcagcacggctgcatggggctggtgcaagtcagcacagccgtgttccgatcgttcacacggcgtttgcatttctcatggttagggtacatttaacagagtaacttcacaattttgatatctaaaaatcactcattttctgcagcatcttccacccttgttagtatatgcctcaacttggccaaattgtcttaattataaaagggatttataatctttagcacaaagataaaa

SEQ ID NO: 127290 - DNA, 3515 bp, Homo sapiens
  Payload ID: 4913
  Gene Symbol: DLGAP2
  Gene Name: discs, large (Drosophila) homolog-associated protein 2
  ENST ID: ENST00000633183
  CDS Start-End: 51-2936
cgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctacaagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtc

SEQ ID NO: 127291 - DNA, 2263 bp, Homo sapiens
  Payload ID: 4913
  Gene Symbol: DLGAP2
  Gene Name: discs, large (Drosophila) homolog-associated protein 2
  ENST ID: ENST00000633645
  CDS Start-End: 1-1684
ccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccatggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtc

SEQ ID NO: 127292 - DNA, 615 bp, Homo sapiens; identical to SEQ ID NO: 127289
  Payload ID: 4913
  Gene Symbol: DLGAP2
  Gene Name: discs, large (Drosophila) homolog-associated protein 2
  ENST ID: ENST00000518530
  CDS Start-End: 1-477

SEQ ID NO: 127293 - DNA, 632 bp, Homo sapiens; identical to SEQ ID NO: 127287
  Payload ID: 4913
  Gene Symbol: DLGAP2
  Gene Name: discs, large (Drosophila) homolog-associated protein 2
  ENST ID: ENST00000522499
  CDS Start-End: 1-530

SEQ ID NO: 127294 - DNA, 8796 bp, Homo sapiens
  Payload ID: 4913
  Gene Symbol: DLGAP2
  Gene Name: discs, large (Drosophila) homolog-associated protein 2
  ENST ID: ENST00000633447
  CDS Start-End: 1-1726
ccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccatggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaagtaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcaccttgatttgcactttacaatgtccccagcccctctgcagcccgtggctggcagggcgttcgatgtgcggttggcccccagcgcgccctccagagctgcggtgtctccctgcctcattccccacatcccactgagcatgggaccactgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaatccctgaaatattcttctataaatgaatcctatttccccagagtgttcaaggcatttttctacctaaatgaatacctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtccctggcctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacgttttcaccattacttaagctcaatcgcctcttagatgaaatgaggagataaactaaacattaaaatgatgaaggaaaaaaaattatttggaagccgaaaaccgcatgggtggggaaacatcaggaacgaaatcagacacactgactcaaaccacgcaagggtttgagaagcccacccctctaattccaggcgtttgtaatttctctacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttaa

SEQ ID NO: 127295 - DNA, 1252 bp, Homo sapiens
  Payload ID: 4913
  Gene Symbol: DLGAP2
  Gene Name: discs, large (Drosophila) homolog-associated protein 2
  ENST ID: ENST00000633162
  CDS Start-End: 51-1252
cgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagac

SEQ ID NO: 127296 - DNA, 3587 bp, Homo sapiens
  Payload ID: 4914
  Gene Symbol: DLGAP3
  Gene Name: discs, large (Drosophila) homolog-associated protein 3
  Uniprot ID: O95886
  ENST ID: ENST00000235180
  CDS Start-End: 1-2940
atgaggggttaccatggcgaccgaggcagccatccccgcccagcccgctttgctgaccaacagcatatggacgtgggccctgctgccagggccccatacctgctgggctccagggaggccttctccaccgagccccgcttctgtgccccgagagctggcctgggacacatttctcctgaagggcccctgagcctgagtgaggggccgtcggtaggccctgagggagggccagcgggggccggggttggggggggtagcagcaccttccccaggatgtaccctggccagggccccttcgacacctgtgaagactgtgtgggccacccacagggcaagggtgccccccgcctgcctcctacactcctggatcagtttgaaaagcagttgccagttcaacaagatggcttccacacactaccataccagcgagggccagcaggggcagggcccgggccagcgccagggacgggcactgccccagagccccgcagtgagagccctagccgcatccggcacctggttcattctgtgcagaagctctttgccaagtcccactctctggaggcgccggggaagcgggactataatgggcccaaggctgagggaagaggtggctctggaggagacagctaccccggcccgggctctggaggcccccacacctcccatcaccaccatcaccaccaccatcaccaccaccaccagtcccggcacggcaagaggagcaagagcaaggaccgcaagggggatgggcggcaccaggccaagtccacaggctggtggagttccgatgacaacttggacagtgatagcggcttcctggcgggtgggaggccccctggggagcctggtggtcccttctgcctggagggtccagatgggtcctaccgggacttgagcttcaaggggcgctcgggcgggtcggaaggccgctgccttgcctgcactggcatgtccatgtcactggatggacagtcggtcaagcgaagtgcctggcataccatgatggtcagccagggccgggatggatacccgggggccgggccaggcaaggggctcctgggtccggagaccaaggccaaagccaggacttatcactatctgcaggtgccgcaagatgactgggggggttaccccaccggtggcaaggatggggagatcccctgccgcaggatgcggagcggcagctacatcaaagccatgggggatgaggagagcggagactcagacggcagccccaagacatctcccaaagcagtcgcccgacgcttcaccacccgtcgctcctccagcgtggaccaggccaggatcaactgctgtgtcccaccccggatccacccccggagctccatccctggctacagccgttccctcaccactggacagctcagcgatgagttgaaccagcagctggaggccgtgtgcgggtcggtgtttggggagctggagtcccaggccgtggacgccctggacctgcccggctgtttccgcatgcggagccacagctacctccgggccatccaggccggctgctctcaagacgacgactgcctgcccctcctcgctacccctgccgctgtctcagggaggcccggctcctccttcaacttcagaaaggccccgccccccatcccgccgggaagccaggccccgccccgcatctccatcaccgcccagagcagcaccgactccgcgcacgagagcttcacggcggccgagggccccgcccggcgctgcagctccgccgacgggctggacggccccgccatgggtgcgcgcacactggagttggcgccggtgccgccccgggccagccccaagccccccacactcatcatcaagaccatccctggcagggaggagctgcggagcctggcgcggcagcggaagtggcggccgtccattggggtgcaggtggagacgatctcagattcggacaccgagaacaggagccggagggagttccactctattggcgtgcaggtggaagaggacaagaggcgagcaaggttcaagcgctccaatagtgtgacggctggcgtgcaggcagacctggagctggagggcctggcaggcctggccacggtggccacagaagacaaggccctgcagtttggacgctccttccagaggcacgcctctgagccccagcctgggccccgggcccccacctactcagtcttccgcacggtccacacgcagggccagtgggcctaccgcgagggctacccactgccgtacgagccgccggccaccgatgggtcgcccggccctgcccccgcccccacccccggccctggggccggccgccgtgactcctggatagagcgcggttcacgtagcctccccgactcaggccgcgcatccccctgcccacgcgacggcgagtggttcatcaagatgctgcgggcagaggtggagaagctggagcactggtgccagcagatggagcgtgaggcggaggactatgagctacccgaggagatcctggagaagatccgcagtgctgtgggcagcacacaacttctcctgtcccagaaggttcagcagttcttccggctgtgtcagcaaagcatggatcccactgcgttccctgtgcccaccttccaggacctggcgggtttctgggacctcctacagctctccatcgaggatgtgaccctcaagttcctggagctacagcaactcaaggccaacagctggaaactcctggagcctaaggaggagaagaaggtccctccgccgataccaaagaagcccctgcggggccggggcgtgccggtgaaggagcgctccctggactccgtggaccggcagcggcaggaagcgcgcaagcggctcctggcggccaagcgcgccgcttccttccgccacagctcggccaccgagagcgccgacagcatcgagatctacatccccgaggcccagaccaggctgtgaccggtccggcccgcccagcccggcccgggcccgcggttctccacccgtactgtacacccagcgtcgaggtcactgtgaacgcgggccgccccgtgcgcccgccccaccggcaccggacgccccggcccccgggcccgtcacactctcgtgggttttttaccttcctgatcccacgcgaaggcgcccgggctgggcagggggccgtgcctctccgccctgcgcccctcacctggatcccctgcccacctggtccgacgctttgtccccacctcctccccatgggcaccatctctgccattctttcccccacgggccaggccgggccgggtccctcatctgggctctgcgtccccccctcccccaccccgcggggctgggcttcgtggggatcaagcttcgtggctttttatgaagaatcccgaaccctgcctaggagcccgccccaccctcccaggggctccatcctcagccctctgcccactgggcccagggaccacagtggctggaccaacccaggaccagggcgcctgggcctctcccctttcccagcggctggggaggggagatgggggcttcccctcaccacacctgtggctgttcccacatccccttgaatatcccaggaaaaataaaacggcagaactgca

SEQ ID NO: 127297 - DNA, 3856 bp, Homo sapiens
  Payload ID: 4914
  Gene Symbol: DLGAP3
  Gene Name: discs, large (Drosophila) homolog-associated protein 3
  Uniprot ID: O95886
  ENST ID: ENST00000373347
  CDS Start-End: 270-3209
cgcagccggcgcggcccctcagctgggggctccgcagtgccgggccccggtccctgcccgcctgcccaacgccgcagcgcccccggcccgggccgccggcaccatgtaacccggccggagcccgagccgggccaggattcagtggtcctgagccttctgaagttaggcttctgcctggtggtggggatcctgacatcaaggatgggacaccctggatggaggttcctggggcctggcccccaagactatgaagagcctttgctgaggccatgaggggttaccatggcgaccgaggcagccatccccgcccagcccgctttgctgaccaacagcatatggacgtgggccctgctgccagggccccatacctgctgggctccagggaggccttctccaccgagccccgcttctgtgccccgagagctggcctgggacacatttctcctgaagggcccctgagcctgagtgaggggccgtcggtaggccctgagggagggccagcgggggccggggttggggggggtagcagcaccttccccaggatgtaccctggccagggccccttcgacacctgtgaagactgtgtgggccacccacagggcaagggtgccccccgcctgcctcctacactcctggatcagtttgaaaagcagttgccagttcaacaagatggcttccacacactaccataccagcgagggccagcaggggcagggcccgggccagcgccagggacgggcactgccccagagccccgcagtgagagccctagccgcatccggcacctggttcattctgtgcagaagctctttgccaagtcccactctctggaggcgccggggaagcgggactataatgggcccaaggctgagggaagaggtggctctggaggagacagctaccccggcccgggctctggaggcccccacacctcccatcaccaccatcaccaccaccatcaccaccaccaccagtcccggcacggcaagaggagcaagagcaaggaccgcaagggggatgggcggcaccaggccaagtccacaggctggtggagttccgatgacaacttggacagtgatagcggcttcctggcgggtgggaggccccctggggagcctggtggtcccttctgcctggagggtccagatgggtcctaccgggacttgagcttcaaggggcgctcgggcgggtcggaaggccgctgccttgcctgcactggcatgtccatgtcactggatggacagtcggtcaagcgaagtgcctggcataccatgatggtcagccagggccgggatggatacccgggggccgggccaggcaaggggctcctgggtccggagaccaaggccaaagccaggacttatcactatctgcaggtgccgcaagatgactgggggggttaccccaccggtggcaaggatggggagatcccctgccgcaggatgcggagcggcagctacatcaaagccatgggggatgaggagagcggagactcagacggcagccccaagacatctcccaaagcagtcgcccgacgcttcaccacccgtcgctcctccagcgtggaccaggccaggatcaactgctgtgtcccaccccggatccacccccggagctccatccctggctacagccgttccctcaccactggacagctcagcgatgagttgaaccagcagctggaggccgtgtgcgggtcggtgtttggggagctggagtcccaggccgtggacgccctggacctgcccggctgtttccgcatgcggagccacagctacctccgggccatccaggccggctgctctcaagacgacgactgcctgcccctcctcgctacccctgccgctgtctcagggaggcccggctcctccttcaacttcagaaaggccccgccccccatcccgccgggaagccaggccccgccccgcatctccatcaccgcccagagcagcaccgactccgcgcacgagagcttcacggcggccgagggccccgcccggcgctgcagctccgccgacgggctggacggccccgccatgggtgcgcgcacactggagttggcgccggtgccgccccgggccagccccaagccccccacactcatcatcaagaccatccctggcagggaggagctgcggagcctggcgcggcagcggaagtggcggccgtccattggggtgcaggtggagacgatctcagattcggacaccgagaacaggagccggagggagttccactctattggcgtgcaggtggaagaggacaagaggcgagcaaggttcaagcgctccaatagtgtgacggctggcgtgcaggcagacctggagctggagggcctggcaggcctggccacggtggccacagaagacaaggccctgcagtttggacgctccttccagaggcacgcctctgagccccagcctgggccccgggcccccacctactcagtcttccgcacggtccacacgcagggccagtgggcctaccgcgagggctacccactgccgtacgagccgccggccaccgatgggtcgcccggccctgcccccgcccccacccccggccctggggccggccgccgtgactcctggatagagcgcggttcacgtagcctccccgactcaggccgcgcatccccctgcccacgcgacggcgagtggttcatcaagatgctgcgggcagaggtggagaagctggagcactggtgccagcagatggagcgtgaggcggaggactatgagctacccgaggagatcctggagaagatccgcagtgctgtgggcagcacacaacttctcctgtcccagaaggttcagcagttcttccggctgtgtcagcaaagcatggatcccactgcgttccctgtgcccaccttccaggacctggcgggtttctgggacctcctacagctctccatcgaggatgtgaccctcaagttcctggagctacagcaactcaaggccaacagctggaaactcctggagcctaaggaggagaagaaggtccctccgccgataccaaagaagcccctgcggggccggggcgtgccggtgaaggagcgctccctggactccgtggaccggcagcggcaggaagcgcgcaagcggctcctggcggccaagcgcgccgcttccttccgccacagctcggccaccgagagcgccgacagcatcgagatctacatccccgaggcccagaccaggctgtgaccggtccggcccgcccagcccggcccgggcccgcggttctccacccgtactgtacacccagcgtcgaggtcactgtgaacgcgggccgccccgtgcgcccgccccaccggcaccggacgccccggcccccgggcccgtcacactctcgtgggttttttaccttcctgatcccacgcgaaggcgcccgggctgggcagggggccgtgcctctccgccctgcgcccctcacctggatcccctgcccacctggtccgacgctttgtccccacctcctccccatgggcaccatctctgccattctttcccccacgggccaggccgggccgggtccctcatctgggctctgcgtccccccctcccccaccccgcggggctgggcttcgtggggatcaagcttcgtggctttttatgaagaatcccgaaccctgcctaggagcccgccccaccctcccaggggctccatcctcagccctctgcccactgggcccagggaccacagtggctggaccaacccaggaccagggcgcctgggcctctcccctttcccagcggctggggaggggagatgggggcttcccctcaccacacctgtggctgttcccacatccccttgaatatcccaggaaaaataaaacggcagaactgca

SEQ ID NO: 127298 - DNA, 5016 bp, Homo sapiens
  Payload ID: 4915
  Gene Symbol: DLGAP4
  Gene Name: discs, large (Drosophila) homolog-associated protein 4
  Uniprot ID: Q9Y2H0
  ENST ID: ENST00000339266
  CDS Start-End: 436-3414
ggggcgcccgcgggccggagccggggcgggggccggggcctaggcgcgcggacctgcgagcggacccgagaggcggcggcggcgcagcggaacggcagagcgggccggaggcggccgaggcgcccggcgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgta

SEQ ID NO: 127299 - DNA, 2392 bp, Homo sapiens
  Payload ID: 4915
  Gene Symbol: DLGAP4
  Gene Name: discs, large (Drosophila) homolog-associated protein 4
  Uniprot ID: Q9Y2H0
  ENST ID: ENST00000340491
  CDS Start-End: 823-2184
gtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaa

SEQ ID NO: 127300 - DNA, 3337 bp, Homo sapiens
  Payload ID: 4915
  Gene Symbol: DLGAP4
  Gene Name: discs, large (Drosophila) homolog-associated protein 4
  Uniprot ID: Q9Y2H0
  ENST ID: ENST00000373907
  CDS Start-End: 200-3178
cggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggctttt

SEQ ID NO: 127301 - DNA, 5056 bp, Homo sapiens
  Payload ID: 4915
  Gene Symbol: DLGAP4
  Gene Name: discs, large (Drosophila) homolog-associated protein 4
  Uniprot ID: Q9Y2H0
  ENST ID: ENST00000373913
  CDS Start-End: 481-3450
cccgcagccgcatctggggcgccgcgccggccggaggagaggcatggggcgcccgcgggccggagccggggcgggggccggggcctaggcgcgcggacctgcgagcggacccgagaggcggcggcggcgcagcggaacggcagagcgggccggaggcggccgaggcgcccggcgcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaccaa

SEQ ID NO: 127302 - DNA, 4881 bp, Homo sapiens
  Payload ID: 4915
  Gene Symbol: DLGAP4
  Gene Name: discs, large (Drosophila) homolog-associated protein 4
  Uniprot ID: Q9Y2H0
  ENST ID: ENST00000401952
  CDS Start-End: 308-3277
gcaggcacccgtgcctcccctctgccaggaaccttggggccttgtgtgtgaccaggacctggtggcccccgggcggtggcagagcccctgtcccaagctgcttcctgccggcacctctgatcaagtgcctagagggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatcatgaaaggcctcggtgacagccgcccccgccacctctccgacagcctagacccaccccacgagcccctgtttgcagggaccgaccgcaacccctacctgctgtcgcccacggaggccttcgcccgcgaggcccgcttccccgggcagaacaccctgccaggagatggcctctttcccctcaacaaccagctgcccccgcccagcagcacctttccccgcatccactacaactcccacttcgaggtgccagaggagagccccttccccagccatgcccaagccaccaagatcaaccggctgcccgccaacctcctggaccagtttgagaagcagctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgcccggcggcggcggcgagtggagcaccacgctgctgtccccacgcgagacggatgccgcggccgagggccctatcccgtgccggcgcatgcgcagcggcagctacatcaaggccatgggcgacgaggacagcgacgagtccggcggcagccccaagccctcacccaagaccgcggcgcggcgccagagctatctgagggccacgcagcagtcgctgggagagcagagcaacccccgcaggagtctggaccgcctggattcagtggacatgctgctgccctccaagtgtccgagctgggaagaggactacacccccgtcagcgacagcctcaacgactccagctgcatcagccagatttttggacaggcctccctgatcccccagttgtttggccatgagcagcaggtacgggaggcagagctgagtgaccagtatgaggcggcctgcgagtcagcctgcagtgaagcggagtccacagcggcagagacgcttgacttgccactgcccagctacttccgctcccgcagccacagctacctgcgtgccatccaggcaggctgctcgcaggaggaggacagtgtctccctgcagtccctctccccaccgcccagtaccggcagcctcagcaatagtcgcacgcttccgagttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtacc

SEQ ID NO: 127303 - DNA, 2396 bp, Homo sapiens
  Payload ID: 4915
  Gene Symbol: DLGAP4
  Gene Name: discs, large (Drosophila) homolog-associated protein 4
  ENST ID: ENST00000489701
  CDS Start-End: 1229-1963
tcactttcctcttaccgaatcaggcctggacttgctttctggctgggttactttccctctgatgactggctgcctaggccagggctcagggcgtctgagggtgcttagtagaactctgggcccagcagctctgagagagaggctggagggtcagtcctttgtccagaccctgactgtgggcagtcctgttgtcttccattgggaagaaggtgtgcctcttcccaccagaacctcgtgaatgctgcatgcacactcttcatggacagtgtcatccctaccccacagatgggaacaaggactctggtgtcacacagcctaagctaggcttagtgcccagttcttgctcccccatactaactgctaccctcctaagggagatatactcccttaaacattttgagcaaattgaggttggcttccgttttctgatctagggcaaaaaaccccatttgtttgggactttaggtcaaacaaatccattcctttcctgaaatcctcagtgagttagtcctgtctctgctggtggccatagatttcaagagttgctctaaacaaacgtccaggtcttggtggaaactgtccctgggccagtcagagaaccagcccagactccctgccagtggctggggagtggtagaaatttggctcgcccccccatccccaccctacccacaggcccagttgtgtctgtaccagaaatgaggagtgatgccaagcctaggcctggcccagccttagcttctgcaatgcaacctatgtaatcacacccattttacaaggaggaaactggggccatacaacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggtgagcatggagcagtgcggaggggaagtccagggacaaattcctggtcggcaataacgctgcccacatcggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcac

SEQ ID NO: 127304 - DNA, 3110 bp, Homo sapiens
  Payload ID: 4915
  Gene Symbol: DLGAP4
  Gene Name: discs, large (Drosophila) homolog-associated protein 4
  ENST ID: ENST00000475894
  CDS Start-End: 647-1504
acatgccaagcgggctgcgcgcgcccctgcccggcccgggagtccctgacgacgcgcgcgcggctgacgcggggggcggggaggggcggggcaggtgcgggactttaacccggagccccgcccctcgggcgtacaaaaccggagcctcgggccgggctgcgtgagggaggagggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaagtcttaggaaaagtcctcagtgctgtgggcagtgcccagctactgatgtcccagaaattccagcagttccggggcctctgtgagcaaaacttgaaccctgatgccaacccacgccccacagcccaggacctggcagggttctgggacctgctacagctgtccatcgaggatatcagcatgaagttcgatgaactctaccacctcaaggccaacagctggcagctggtggagacccccgagaagaggaaggaagagaagaaaccaccccctccggtcccaaagaagccagccaaatccaagccggcagtgagccgcgacaaggcctcagacgccagcgacaagcagcgccaggaggcccgcaagagactcctggcggccaagcgggcagcttctgtgcggcagaactcagccaccgagagcgcagacagcatcgagatttatgtcccggaggcccagaccaggctctgagaccatgcaggaggaaagaaacgattttaaatcattaaaaacacaaaaactaagtgcgaacggaacagagttttctcaacctttgctatggttattctgtctagagaccctgagccaactttcaaattgacgcatacaagggctcacaatttggcttttttgggtccctcccagctttaggttatgaagattttactcacaaaaaaaatcaacaaaaatcacgaaactagaaaactttttttttcctcttgctggccgtggtggactagatagatggacgtcggcaactcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagaggacagagagatggacatgcgtcccctccctccccccgccaagtgctcacacacaacctcacgcgcacacacacacacgcagatggaggcgcctcactgggaggtgccccgccagccctgggcagtgtcaggcaggactcactcaccgctgagcagatgagggaagttttagtcttggcgggtggaaatgagacgaagccacagttatcacactccagactcctgcccttttattttctccagccccttcttccttcagcaaaatctaggactcccgagtggcttccagggggccgtcagtcctcagccgcgcctgtgtccggtgcccgaggggcgggcggcggtgtctgtatgtatgtgtacatatgcacatagaccttagagtgtatagttaacaaacgcccatctgctcacccatgcccacccagcgccgccgccgctggctctcggggcacctggcaggaggcgggtgtgtgaatagcatatatttttacatgtactatatctaggtgtgtgtacaagtgtgtgtaaaaatatataccttgtgtgtaagcagccctttttttttttggtctccacccccctccccccgccccgcactcctaagggcccatctgcccagcctctgagttttctgttctattttttttttaaccccaattatccttctctctctcctgcccccgcatcccactcccagggtgtcacgagccctgagctgcaatggcccgggcctgcagggcggggtaggggagggcaggggctgagccccgaagccagctcagtacctgaggggctgctctatgctgtgtatgcgcctctctggcatccgagacatcctcttggctggcgcttgctgcagggggggacccccccccgtccccaggtgaaccaagggtctgctccggggcccatttccagcttggccgccgtctgtgaccttgggcaagtcacttgacctctgtgtgcctcaacttcctcctctgtaaaacggggacagtccctgcccctccctacctcacaggcatgttgtgagaataaatgaggtaacgtgtaccaa

SEQ ID NO: 127305 - DNA, 839 bp, Homo sapiens
  Payload ID: 4915
  Gene Symbol: DLGAP4
  Gene Name: discs, large (Drosophila) homolog-associated protein 4
  ENST ID: ENST00000482872
  CDS Start-End: 700-839
gtacaaaaccggagcctcgggccgggctgcgtgagggaggagggctgtgtgaggcattgtgtaatcagccaggctctttcccgaccattgttctccaccaacaggcctggaagtcggaagccagtggagttctccctgtttcacaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagagaggactagaaggaacggttcccacctctcggaggacaacggacccaaagcgatcgatgtgatggcaccctcctcagagttgactgcattcagccagtgccaaaagaggagcccagtcccgctaccaaattccagtccatcggggttcaggtagaggacgactggcgaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaa

SEQ ID NO: 127306 - DNA, 794 bp, Homo sapiens
  Payload ID: 4915
  Gene Symbol: DLGAP4
  Gene Name: discs, large (Drosophila) homolog-associated protein 4
  ENST ID: ENST00000495241
  CDS Start-End: 418-794
ggagcctcgggccgggctgcgtgagggaggagggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaaaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaa

SEQ ID NO: 127307 - DNA, 2973 bp, Homo sapiens
  Payload ID: 4916
  Gene Symbol: DLGAP5
  Gene Name: discs, large (Drosophila) homolog-associated protein 5
  Uniprot ID: Q15398
  ENST ID: ENST00000247191
  CDS Start-End: 218-2758
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgt

SEQ ID NO: 127308 - DNA, 2954 bp, Homo sapiens
  Payload ID: 4916
  Gene Symbol: DLGAP5
  Gene Name: discs, large (Drosophila) homolog-associated protein 5
  Uniprot ID: Q15398
  ENST ID: ENST00000395425
  CDS Start-End: 84-2612
cttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaatcatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcagtgggatcttgctatgttgctcgggctggtcttgaagtcctgggttcaagtgatcctaccacctcagcctcccgagtagctgggactacagccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaagg

SEQ ID NO: 127309 - DNA, 808 bp, Homo sapiens
  Payload ID: 4916
  Gene Symbol: DLGAP5
  Gene Name: discs, large (Drosophila) homolog-associated protein 5
  ENST ID: ENST00000557645
  CDS Start-End: 106-808
catggcaactaaaaacgcccggttgagaacctctagtcaagcaagattaacgcattctggactttcaagctggaggaaacgccactcagccaaacaaaatttaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatg

SEQ ID NO: 127310 - DNA, 641 bp, Homo sapiens
  Payload ID: 4916
  Gene Symbol: DLGAP5
  Gene Name: discs, large (Drosophila) homolog-associated protein 5
  ENST ID: ENST00000554067
  CDS Start-End: 256-588
tccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggtcccatggcaactaaaaacgcccggttgagaacctctagtcaagcaagattaacgcattctggactttcaagctggaggaaacgccactcagccaaacaaaatttaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttg

SEQ ID NO: 127311 - DNA, 5034 bp, Homo sapiens
  Payload ID: 4917
  Gene Symbol: DLG1
  Gene Name: discs, large homolog 1 (Drosophila)
  Uniprot ID: Q12959
  ENST ID: ENST00000346964
  CDS Start-End: 191-2971
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 127312 - DNA, 4931 bp, Homo sapiens
  Payload ID: 4917
  Gene Symbol: DLG1
  Gene Name: discs, large homolog 1 (Drosophila)
  ENST ID: ENST00000357674
  CDS Start-End: 191-2869
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgg

SEQ ID NO: 127313 - DNA, 716 bp, Homo sapiens
  Payload ID: 4917
  Gene Symbol: DLG1
  Gene Name: discs, large homolog 1 (Drosophila)
  ENST ID: ENST00000392380
  CDS Start-End: 93-716
gcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaa

SEQ ID NO: 127314 - DNA, 2833 bp, Homo sapiens
  Payload ID: 4917
  Gene Symbol: DLG1
  Gene Name: discs, large homolog 1 (Drosophila)
  ENST ID: ENST00000392381
  CDS Start-End: 475-2451
ggcggaaagtttcgggggagagcggttgggggcgcggaaggaggcgaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcgccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcaggtatgcctgtttcttaccacttgaatgtgaggcaacataaataattgatgttcttttaaattttttttaatttgtgacaacatggatggacctggagtgcattattctaattgaaaaaagccagacacagaaagacaaaaatcgtatgatcacatttttatgtgaaatctaaagtagtcgaagtcatacagagaagaatggtggttaccaggggttaggaggatggggaaatgagatacaaagtttccgtgacacaagatgagtgagttctgcacctccaacatagttgagaagaaagaacgagcccgattaaaaacagtgaaattcaattctaaaacgagagataaagggttcctcagagccttcaaactttaagattgaaatcaagacagtctgcttggctaatgaactgtgaacttatt

SEQ ID NO: 127315 - DNA, 2690 bp, Homo sapiens
  Payload ID: 4917
  Gene Symbol: DLG1
  Gene Name: discs, large homolog 1 (Drosophila)
  Uniprot ID: Q12959
  ENST ID: ENST00000392382
  CDS Start-End: 75-2690
ggcggaaagtttcgggggagagcggttgggggcgcggaaggaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatga

SEQ ID NO: 127316 - DNA, 710 bp, Homo sapiens
  Payload ID: 4917
  Gene Symbol: DLG1
  Gene Name: discs, large homolog 1 (Drosophila)
  ENST ID: ENST00000412364
  CDS Start-End: 393-710
ctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagag

SEQ ID NO: 127317 - DNA, 2977 bp, Homo sapiens
  Payload ID: 4917
  Gene Symbol: DLG1
  Gene Name: discs, large homolog 1 (Drosophila)
  Uniprot ID: Q12959
  ENST ID: ENST00000448528
  CDS Start-End: 191-2905
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctgga

SEQ ID NO: 127318 - DNA, 543 bp, Homo sapiens
  Payload ID: 4917
  Gene Symbol: DLG1
  Gene Name: discs, large homolog 1 (Drosophila)
  ENST ID: ENST00000436682
  CDS Start-End: 174-543
agcaaggagaaaggcaagcgagaggagggggcccgagcagggcgggcggccagtcccgctggtcccctctcagcgctctgcggccgctgctggctcaggggccaagggtcggagcgcttcacccgcccgtacccagtagcaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccac

SEQ ID NO: 127319 - DNA, 629 bp, Homo sapiens
  Payload ID: 4917
  Gene Symbol: DLG1
  Gene Name: discs, large homolog 1 (Drosophila)
  ENST ID: ENST00000456699
  CDS Start-End: 93-629
gcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttac

SEQ ID NO: 127320 - DNA, 2516 bp, Homo sapiens
  Payload ID: 4917
  Gene Symbol: DLG1
  Gene Name: discs, large homolog 1 (Drosophila)
  Uniprot ID: Q12959
  ENST ID: ENST00000443183
  CDS Start-End: 51-2453
agctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttacctaatcttgattacagatgagtatggctgctcaaaaggtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctt

SEQ ID NO: 127321 - DNA, 1771 bp, Homo sapiens
  Payload ID: 4917
  Gene Symbol: DLG1
  Gene Name: discs, large homolog 1 (Drosophila)
  ENST ID: ENST00000419227
  CDS Start-End: 191-1303
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgcgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagcagtcattcaatgacaagcgtaaaaagaacctcttttcccgaaaattccccttctacaagaacaaggaccagagtgagcaggaaacaagtgatgctgaccgagatccctgacgacatgggatcaaaaggcctgaagcatgtaacttctaatgccagcgatagtgaaagtagttaccgt

SEQ ID NO: 127322 - DNA, 858 bp, Homo sapiens
  Payload ID: 4917
  Gene Symbol: DLG1
  Gene Name: discs, large homolog 1 (Drosophila)
  ENST ID: ENST00000447466
  CDS Start-End: 1-858
tttttcactcgaagacacagctttattgactgcatctcggtagccaccagctccacccaggcaaatcctcccccagtactggtcaacacagatagcttggaaacaccaacttacggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggt

SEQ ID NO: 127323 - DNA, 3053 bp, Homo sapiens
  Payload ID: 4917
  Gene Symbol: DLG1
  Gene Name: discs, large homolog 1 (Drosophila)
  Uniprot ID: Q12959
  ENST ID: ENST00000452595
  CDS Start-End: 324-2690
atcagctaacaaaagaacagcttttggttcctgcagacgctggtgaaaaaataatcatgagaaagaaatccaccttatgtcgtcttttttgtctgcaaaaataaactcagccatcatacagctaacaggtacagagggaagatacgagctctttcataggaagaaatcactgagaaaatgagcatcatttctcaaggtttttattttcactgatctacaagtgatgctgctgtaattgtagctgcagtttttaccgatcattcaccactcagcagctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaa

SEQ ID NO: 127324 - DNA, 309 bp, Homo sapiens
  Payload ID: 4917
  Gene Symbol: DLG1
  Gene Name: discs, large homolog 1 (Drosophila)
  ENST ID: ENST00000434148
  CDS Start-End: 203-309
tgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtgtgtgccctcttcctgattctggagaaaaatgccggtccggaagcaagatacccagagagcattgcaccttttggaggaatatcgttcaaaactaagccaaactgaagacagacagctcagaagttccatagaacg

SEQ ID NO: 127325 - DNA, 3994 bp, Homo sapiens
  Payload ID: 4917
  Gene Symbol: DLG1
  Gene Name: discs, large homolog 1 (Drosophila)
  Uniprot ID: Q12959
  ENST ID: ENST00000419354
  CDS Start-End: 288-3002
agttctgtcactcactcggggtaactttgggcaaattctctctggacctcctaatagggaggtcctcgtcaccccgaggaagttcgaagacgtgggcagtgacttggaaagcttcccgagattccccttctataacctgggtggctcagaccgggagcggggtcccagccggccggtaattccgcccggaggtgcgcacgaaacaaacctgcagcgctggccgagggcggctcagcttcggagggcgcgactccgggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaa

SEQ ID NO: 127326 - DNA, 2682 bp, Homo sapiens
  Payload ID: 4917
  Gene Symbol: DLG1
  Gene Name: discs, large homolog 1 (Drosophila)
  Uniprot ID: Q12959
  ENST ID: ENST00000450955
  CDS Start-End: 1-2682
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatga

SEQ ID NO: 127327 - DNA, 539 bp, Homo sapiens
  Payload ID: 4917
  Gene Symbol: DLG1
  Gene Name: discs, large homolog 1 (Drosophila)
  ENST ID: ENST00000453607
  CDS Start-End: 174-539
gtagaaaaattgctacctctaagaatggatcctggagagatctagttacagttataacttcttcatttatggttttatctcacagctttatttatttttatttacatgttttgttcaactaggcaacttaaaatagttttgctttatgtataaaatattgtaatggtagagtaatggattgcctgtgcattgtaaccacaaagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaaga

SEQ ID NO: 127328 - DNA, 2854 bp, Homo sapiens
  Payload ID: 4917
  Gene Symbol: DLG1
  Gene Name: discs, large homolog 1 (Drosophila)
  Uniprot ID: Q12959
  ENST ID: ENST00000422288
  CDS Start-End: 1-2562
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaa

SEQ ID NO: 127329 - DNA, 582 bp, Homo sapiens
  Payload ID: 4917
  Gene Symbol: DLG1
  Gene Name: discs, large homolog 1 (Drosophila)
  ENST ID: ENST00000419553
  CDS Start-End: 120-582
ggtggggatctacccccggggtcgccaggcgctgtctctgccgcggagttggaaacggcactgctgagtgaggttgaggggtgtctcggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcatt

SEQ ID NO: 127330 - DNA, 7730 bp, Homo sapiens
  Payload ID: 4918
  Gene Symbol: DLG2
  Gene Name: discs, large homolog 2 (Drosophila)
  Uniprot ID: Q15700
  ENST ID: ENST00000280241
  CDS Start-End: 195-2924
gcagataatgctgtgcggagctgctgtcgctgctcccactgctcccacgatgcactgcttatagcagctgtcaaagatactgaggaatccacggtggaaaaaagacttttacaactggctggaagaaaggggtgtgagggaggagacatttctgtgcagagctgaccaaaggaaagagtaggcatcagtgcagtatgaatgcatacctcaccaagcaacacagctgcagccgggggtccgatgggatggatgccgtcaggagtgcgcccaccctgatcagggatgcccactgtgcttgtggctggcagaggaactgtcaggggctcgggtacagttctcagaccatgccctcctcaggaccagggggcccagcttcaaacaggaccggggggtccagcttcaacaggaccttgtgggacagtgtgcggaaaagcccccacaagacgagcaccaagggcaaagggacttgtggggagcattgtacctgcccacatggttggttcagcccagcacaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaatgcaaaattatgcatcttcccatagtcctgaggcttcctttgccaatggaagggctagcaatgcattctccctctcatgaaagttaaatttccagagacttccttagattgctcaaaatgttaaagatatgtccatgtctgcaattcgccagtttcaggtcaaggcctactttcatcaatattgctcccagaagttttctgacaccagaatgccattcctgatcccagctctatttttaggccaccacgataacttctttggtttctcaactgagcatgcaaccatttatttaaaagactgtcattaatgagtagatgttttcgcgggtcgtgtgatgtgctttccatttactagtgttgctgtggctaagtacaatcaaattgaaccaccaacccttggttttgtagtaatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctctttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaatcaagatgtatatttcatactcagtgtgtctgtgcatatttattgcgtttctagttgtcagcggtgggtggccccattgtaaaaatgcctgatagagtgtttataaacatgtcatggttttattataagatataaatattaaaacattttatactttatggcaaa

SEQ ID NO: 127331 - DNA, 5139 bp, Homo sapiens
  Payload ID: 4918
  Gene Symbol: DLG2
  Gene Name: discs, large homolog 2 (Drosophila)
  Uniprot ID: Q15700
  ENST ID: ENST00000376104
  CDS Start-End: 313-3240
acagaagaaaaaaatgaaagggacagcaagctggattctgagttactgaggggaagactcagcctggatttcaaaactgaacactgaagtggtttgcaacagttacctggctcttggcctcaatccagctggatcaaactgagacctgaaaagagatattgactcctgtggcagtggaaagacccaagaatgccagtcaagaagacaggtgggccataagatactgaccgagctttatcattactggaagaatactgcaaaaaattaaggaaaccagaggagcagctgttgaaaaatgcggttaaaaaggtgatgggtatctttaagagcagcttattccaagctttgctagatatccaagaattttatgaggtgacattgctaaattctcaaaaaagttgtgagcagaagatagaagaagccaatcaagttttacagaaatgggagaagacatcccttcttgctccgtgccatgacagacttcaaaaatcttcagagcttacagattgcagtggatcaaaggaaaatgcttcatgtattgagcaaaataaagaaaatcagagttttgaaaatgaaactgatgagacgacaactcaaaaccaaggcagatgcccagcccagaattgttcagtggaagcccctgcttggatgcctgtccaccactgtactaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaa

SEQ ID NO: 127332 - DNA, 738 bp, Homo sapiens
  Payload ID: 4918
  Gene Symbol: DLG2
  Gene Name: discs, large homolog 2 (Drosophila)
  ENST ID: ENST00000398299
  CDS Start-End: 41-738
gtgaagctctccgggccccaaactatcagtagcataaaatatgaccaaggtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataa

SEQ ID NO: 127333 - DNA, 2070 bp, Homo sapiens
  Payload ID: 4918
  Gene Symbol: DLG2
  Gene Name: discs, large homolog 2 (Drosophila)
  ENST ID: ENST00000398301
  CDS Start-End: 195-1853
gcagataatgctgtgcggagctgctgtcgctgctcccactgctcccacgatgcactgcttatagcagctgtcaaagatactgaggaatccacggtggaaaaaagacttttacaactggctggaagaaaggggtgtgagggaggagacatttctgtgcagagctgaccaaaggaaagagtaggcatcagtgcagtatgaatgcatacctcaccaagcaacacagctgcagccgggggtccgatgggatggatgccgtcaggagtgcgcccaccctgatcagggatgcccactgtgcttgtggctggcagaggaactgtcaggggctcgggtacagttctcagaccatgccctcctcaggaccagggggcccagcttcaaacaggaccggggggtccagcttcaacaggaccttgtgggacagtgtgcggaaaagcccccacaagacgagcaccaagggcaaagggacttgtggggagcattgtacctgcccacatggttggttcagcccagcacaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaaggtcagtcagaactcaaactaataatgttctgatatgtctctgtgtggatctgtaccctcattactaataatttttattaactagagtcaccatcattggtgttttgtaaacctacctatagtgaaaaattgatggttcatgtccaaagaacgtgaaccgtggctttgttacctctaatcttccaggaaaatatcaagcagttagaaaggcctatgaaaatatgaattcaaataaatagcaaccagcatc

SEQ ID NO: 127334 - DNA, 783 bp, Homo sapiens
  Payload ID: 4918
  Gene Symbol: DLG2
  Gene Name: discs, large homolog 2 (Drosophila)
  ENST ID: ENST00000398304
  CDS Start-End: 157-546
aggcaagtgtgaaccggacagcagacaggagaacctggcaccaaggagacggagaagctgcctttggtgcctcctgcctcctccctgctttgttccaataattttgtgctcgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgaatactttcttcatttgctaaaaagaagaaacagcaatcaagcagcgggttcctgtaaaatggagataaagttttcatcttctttatcttatctgagttttcttaatgcagcctcctctgcggcttttacttgcctttcgctcacatttctggtagccttgcatgagtgtattcctttccgttctggctgctcttcaatgcttggtatctctttaatttgctgtgctgttcttgcagaacatgtttcttctaatgcca

SEQ ID NO: 127335 - DNA, 2789 bp, Homo sapiens
  Payload ID: 4918
  Gene Symbol: DLG2
  Gene Name: discs, large homolog 2 (Drosophila)
  ENST ID: ENST00000330014
  CDS Start-End: 18-2393
aacaatgtgaacaagctatgcaacatgcatttattccggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccatta

SEQ ID NO: 127336 - DNA, 7890 bp, Homo sapiens
  Payload ID: 4918
  Gene Symbol: DLG2
  Gene Name: discs, large homolog 2 (Drosophila)
  Uniprot ID: Q15700
  ENST ID: ENST00000398309
  CDS Start-End: 472-3084
atttacagtctgcgatgcgatcccattgtaaagtatttaataggataacaccggggctctccagaaatataagtaactcattggttaaatttcaattcttcacctttccccccctccttcctgagtgagctcattcccccctccttcttcttcttcttttttttttttaatccagtgatttaaaatgctagaaggaaaagcaactgaggtcttaactttcagacgctgaattctcatctaattgaaattactgggcataatgctatatatagccaatgaagagattttgagctctcactcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaatgcaaaattatgcatcttcccatagtcctgaggcttcctttgccaatggaagggctagcaatgcattctccctctcatgaaagttaaatttccagagacttccttagattgctcaaaatgttaaagatatgtccatgtctgcaattcgccagtttcaggtcaaggcctactttcatcaatattgctcccagaagttttctgacaccagaatgccattcctgatcccagctctatttttaggccaccacgataacttctttggtttctcaactgagcatgcaaccatttatttaaaagactgtcattaatgagtagatgttttcgcgggtcgtgtgatgtgctttccatttactagtgttgctgtggctaagtacaatcaaattgaaccaccaacccttggttttgtagtaatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctctttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaatcaagatgtatatttcatactcagtgtgtctgtgcatatttattgcgtttctagttgtcagcggtgggtggccccattgtaaaaatgcctgatagagtgtttataaacatgtcatggttttattataagatataaatattaaaacattttatactttatggcaaa

SEQ ID NO: 127337 - DNA, 1831 bp, Homo sapiens
  Payload ID: 4918
  Gene Symbol: DLG2
  Gene Name: discs, large homolog 2 (Drosophila)
  ENST ID: ENST00000404783
  CDS Start-End: 313-1359
atatttatcaggatgagttacaaggaaatatatgtacccagtgagcgagaatgctgcatggtcaccccctgtgatgtaaaatatgagaatctaggaggggctgttttataattcatcaggttccgctagtgagttctgtcagagtcttagttataaaggcaagtgtgaaccggacagcagacaggagaacctggcaccaaggagacggagaagctgcctttggtgcctcctgcctcctccctgctttgttccaataattttgtgctcgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgaaacatgtttcttctaatgccagcgatagcgaaagtagctaccgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaaga

SEQ ID NO: 127338 - DNA, 849 bp, Homo sapiens
  Payload ID: 4918
  Gene Symbol: DLG2
  Gene Name: discs, large homolog 2 (Drosophila)
  ENST ID: ENST00000420775
  CDS Start-End: 186-849
agtgagttctgtcagagtcttagttataaaggcaagtgtgaaccggacagcagacaggagaacctggcaccaaggagacggagaagctgcctttggtgcctcctgcctcctccctgctttgttccaataattttgtgctcgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatcc

SEQ ID NO: 127339 - DNA, 5927 bp, Homo sapiens
  Payload ID: 4918
  Gene Symbol: DLG2
  Gene Name: discs, large homolog 2 (Drosophila)
  Uniprot ID: Q15700
  ENST ID: ENST00000426717
  CDS Start-End: 282-1286
atgtacccagtgagcgagaatgctgcatggtcaccccctgtgatgtaaaatatgagaatctaggaggggctgttttataattcatcaggttccgctagtgagttctgtcagagtcttagttataaaggcaagtgtgaaccggacagcagacaggagaacctggcaccaaggagacggagaagctgcctttggtgcctcctgcctcctccctgctttgttccaataattttgtgctcgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagttttgtgaaatattttgtaaagactaatattgaaagactaaatgtatgcaacatcagcagatgatcaaattcaagacctgaaagttgcactctcccttttgttgccaatgatctgttaagagcatctgagttccttttaagtctgacaaagacttcttcctcacttacctcccttccacattagtgatacactctcatgcagcacatcccttaatgagttgccctcatggatatttttggaagacatttggttaatgcatttttttatgctgatggcttttcagagacaaacttatgcaaatgatctaaagggaagtttttgctttcctctagttaaataacctgagcctgccatgcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgatttaaaaaaagaaacctcccaaagcctataaactgaactagaagagttggtttcccactttagagtggatggcgacatcagcattgcttttgcccatggtgtttggggagagacttttcagtgataataaccactctactctgggttctgtgcatgcccagactaagccccatcgccttatttctggggtacatccagacctggcagggattctgccacactgtgcagcaaaccagcatgtaggctgggtaggagagcaagagatagagccatcagagtgatggggcttcttcacagtaagaacatcggagcttagaatgagagtctctttccaaaaacaggcattgttcatcttacgctaaacatcattgtctgcctggctacagtcaccaaaacaaaacagaaatgcaaaattatgcatcttcccatagtcctgaggcttcctttgccaatggaagggctagcaatgcattctccctctcatgaaagttaaatttccagagacttccttagattgctcaaaatgttaaagatatgtccatgtctgcaattcgccagtttcaggtcaaggcctactttcatcaatattgctcccagaagttttctgacaccagaatgccattcctgatcccagctctatttttaggccaccacgataacttctttggtttctcaactgagcatgcaaccatttatttaaaagactgtcattaatgagtagatgttttcgcgggtcgtgtgatgtgctttccatttactagtgttgctgtggctaagtacaatcaaattgaaccaccaacccttggttttgtagtaatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctctttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaa

SEQ ID NO: 127340 - DNA, 3027 bp, Homo sapiens
  Payload ID: 4918
  Gene Symbol: DLG2
  Gene Name: discs, large homolog 2 (Drosophila)
  Uniprot ID: Q15700
  ENST ID: ENST00000418306
  CDS Start-End: 26-2275
agtttgagtgttaccagctttcgctatgcaacggccaagtgtttctcgggctgagaattatcagcttttgtgggatactattgcttccttaaaacaatgtgaacaagctatgcaacatgcatttattccggtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagatgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggtt

SEQ ID NO: 127341 - DNA, 442 bp, Homo sapiens
  Payload ID: 4918
  Gene Symbol: DLG2
  Gene Name: discs, large homolog 2 (Drosophila)
  ENST ID: ENST00000434967
  CDS Start-End: 117-442
agagctgaatttgggaagcagctgcctgctatgctgaaaacccctggaaacttgctaaagagctgtggtgccgatatcacataagatttcaccagggcttcttctagccagaagacatgtcctttgacagccaatgtgaccttcgtagctctgagccagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccag

SEQ ID NO: 127342 - DNA, 496 bp, Homo sapiens
  Payload ID: 4918
  Gene Symbol: DLG2
  Gene Name: discs, large homolog 2 (Drosophila)
  ENST ID: ENST00000457267
  CDS Start-End: 1-496
cgtaaaaagagcttcatcttttcacgaaaattcccattctacaagaacaaggagcagagtgagcaggaaaccagtgatcctgaactaaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagagg

SEQ ID NO: 127343 - DNA, 2872 bp, Homo sapiens
  Payload ID: 4918
  Gene Symbol: DLG2
  Gene Name: discs, large homolog 2 (Drosophila)
  ENST ID: ENST00000524982
  CDS Start-End: 63-2663
gtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgaaacatgtttcttctaatgccagcgatagcgaaagtagctaccgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaag

SEQ ID NO: 127344 - DNA, 2892 bp, Homo sapiens
  Payload ID: 4918
  Gene Symbol: DLG2
  Gene Name: discs, large homolog 2 (Drosophila)
  ENST ID: ENST00000531015
  CDS Start-End: 26-2461
agtttgagtgttaccagctttcgctatgcaacggccaagtgtttctcgggctgagaattatcagcttttgtgggatactattgcttccttaaaacaatgtgaacaagctatgcaacatgcatttattccggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacaggtaagttcacttttaccctggtagtgtgagaaaggggataaattgtctgacatttggcacagagagggttctgggcctggtgtacttgtgccctaaaaccttcctgttgagaatccctaatatctgtttcatatacaaggagtatccctctgcttcacccattttgatgtaaaaccctgggttctcctgagagttcagctgcagccagctcccaggttcccaccagccctacccaaaaccatgggcaggagatacccctgagctatctcctaccatgaaaaggatttgaggcattgctacctcattaaactatctccctgatatcatcagaaaacttgaaaaacaaaattttagggctcaaaatggtcagtgtccaaagcagttactcttgagaagaagcttggaggcgtccgtccccagctccatgagctttcatcagtgtccctatcagcagcacctg

SEQ ID NO: 127345 - DNA, 569 bp, Homo sapiens
  Payload ID: 4918
  Gene Symbol: DLG2
  Gene Name: discs, large homolog 2 (Drosophila)
  ENST ID: ENST00000529401
  CDS Start-End: 26-139
agtttgagtgttaccagctttcgctatgcaacggccaagtgtttctcgggctgagaattatcagcttttgtgggatactattgcttccttaaaacaatgtgaacaagctatgcaacatgcatttattccgttggaataaatcttccttgaagttcatgttattttcaagtgactcaagttagatgccatcatatttttccctgtaacttcgaaatcacttaaatgtcacaaactctgggctatatttgaagctcttctaattgaaccactatattttagttggatcacggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggttt

SEQ ID NO: 127346 - DNA, 559 bp, Homo sapiens
  Payload ID: 4918
  Gene Symbol: DLG2
  Gene Name: discs, large homolog 2 (Drosophila)
  ENST ID: ENST00000529399
  CDS Start-End: 279-559
attaacactacgctgtgaataactttgtttactctcttccacattttaaaagaagataccagactaccacttcagagttggaatttcaaacaccagcagctagctgggaggcaggattgaatttggagataagaattcttcctggcgtccttcagcagcctccccaggcaggttttcacctcttcgacttttccaggactaagcctttttaactgagaagagaaagaaaaagagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagac

SEQ ID NO: 127347 - DNA, 550 bp, Homo sapiens
  Payload ID: 4918
  Gene Symbol: DLG2
  Gene Name: discs, large homolog 2 (Drosophila)
  ENST ID: ENST00000527088
  CDS Start-End: 327-550
gatagaactgtgcggggcactcacaggagccttgttccaatcaaggaatccgctaaaagaccatgcagccacggagcccaggaagccaccgggaagttttgccggagctgatttctaggggattttctggtgcctagcagaatcctgcttgccttgagctgtatggaggagggctcgagtttcccatgaggggcccccttggaaaagccgtctgtacagaatccaagctctgcttctttctgtgtgcaatttccaaaaggcttttctcacctttgctgatttgctggtgtgatttccatgtactgagtcctgtgtagggatccaggatggattgcctgtgcattgtcaccacaaagcaaaaccaaggcagatgcccagcccagaattgttcagtggaagcccctgcttggatgcctgtccaccactgtactaagtatcgatatcaagatgaggacgctccacatgatcattccttacctcgactaacccacgaagtaagaggcccagaactcgtgcatgtatcagaaaagaacctctctcaaatagaaaa

SEQ ID NO: 127348 - DNA, 2891 bp, Homo sapiens
  Payload ID: 4918
  Gene Symbol: DLG2
  Gene Name: discs, large homolog 2 (Drosophila)
  ENST ID: ENST00000532653
  CDS Start-End: 304-2862
aatccagtgatttaaaatgctagaaggaaaagcaactgaggtcttaactttcagacgctgaattctcatctaattgaaattactgggcataatgctatatatagccaatgaagagattttgagctctcactcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcttgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgttcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaacccactaccatttatatgactgatccttatggtccacctgatattactcactcttattctccaccaatggaaaaccatctactctctggcaacaatggcactttagaatataaaacctccctgccacccatctctccaggaaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacag

SEQ ID NO: 127349 - DNA, 547 bp, Homo sapiens
  Payload ID: 4918
  Gene Symbol: DLG2
  Gene Name: discs, large homolog 2 (Drosophila)
  ENST ID: ENST00000524601
  CDS Start-End: 220-547
taaaagatgaaagaaaagccgatgaatcaattattcaccttgatccttggaaggctgctttctttggttgctaaagtttctcaggtttcattctatcagtttcatttgttgggtgagctttgaaaaaaacaagtctctttgtcacgaaattgtttttcttagctgccaaaaggagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggaca

SEQ ID NO: 127350 - DNA, 566 bp, Homo sapiens
  Payload ID: 4918
  Gene Symbol: DLG2
  Gene Name: discs, large homolog 2 (Drosophila)
  ENST ID: ENST00000530800
  CDS Start-End: 65-493
tatacaccaagcagctcaaccaggaggagggaacagagctgaatttgggaagcagctgcctgctatgctgaaaacccctggaaacttgctaaagagctgtgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggttactggagtttaaatatgcttgaaatgtaaaagtggcatgaaactggagtgatgcaagaatatttagtattcttttaaggactatcatttttaact

SEQ ID NO: 127351 - DNA, 6112 bp, Homo sapiens
  Payload ID: 4919
  Gene Symbol: DLG3
  Gene Name: discs, large homolog 3 (Drosophila)
  ENST ID: ENST00000194900
  CDS Start-End: 342-2891
cagagcagaagcggtcctcacagcacccattctctgcttgagctcccgcttcttctttgccgctgggcctcggcccagaagccacgacgggcgacacggagccgccagtgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggccaggcctgcacccctcctagtgaaccctgagacactgaagcacagcctctcggtgaatggcagtgatggcatgttcaaatatgaggaaatcgtacttgagaggggcaactctggcctgggcttcagtatcgcaggtggcatcgacaatccccatgtccctgatgaccctggcatctttattaccaagattatccctggtggagcagctgccatggatgggaggctgggggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcacaaa

SEQ ID NO: 127352 - DNA, 5074 bp, Homo sapiens
  Payload ID: 4919
  Gene Symbol: DLG3
  Gene Name: discs, large homolog 3 (Drosophila)
  Uniprot ID: Q92796
  ENST ID: ENST00000374355
  CDS Start-End: 318-1856
ggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 127353 - DNA, 5905 bp, Homo sapiens
  Payload ID: 4919
  Gene Symbol: DLG3
  Gene Name: discs, large homolog 3 (Drosophila)
  Uniprot ID: Q92796
  ENST ID: ENST00000374360
  CDS Start-End: 234-2687
tgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatctttattaccaagattatccctggtggagcagctgccatggatgggaggctgggggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 127354 - DNA, 4529 bp, Homo sapiens
  Payload ID: 4919
  Gene Symbol: DLG3
  Gene Name: discs, large homolog 3 (Drosophila)
  Uniprot ID: Q92796
  ENST ID: ENST00000542398
  CDS Start-End: 213-1313
cccatcgcgcgcctcaggcgtctcctcctcctccctccttccccctcctctctcctcccctcctcccgcgcgccccgctttgtgtccgtggtctcccgcgcgggacggagggactggccggagctggcgctttctcagcactagatctggactccgacccggcgccagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctggcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagc

SEQ ID NO: 127355 - DNA, 3184 bp, Homo sapiens
  Payload ID: 4920
  Gene Symbol: DLG4
  Gene Name: discs, large homolog 4 (Drosophila)
  Uniprot ID: P78352
  ENST ID: ENST00000302955
  CDS Start-End: 201-2366
gcccccttcccctccctcccacgctcccctccccttcccttctccaaccccctccttcccctctcacccctccccccatcctggccccccctgcaaaagtggggtgcggaggggggaggggtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 127356 - DNA, 3185 bp, Homo sapiens
  Payload ID: 4920
  Gene Symbol: DLG4
  Gene Name: discs, large homolog 4 (Drosophila)
  Uniprot ID: P78352
  ENST ID: ENST00000399506
  CDS Start-End: 193-2367
cccctccctcccacgctcccctccccttcccttctccaaccccctccttcccctctcacccctccccccatcctggccccccctgcaaaagtggggtgcggaggggggaggggtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 127357 - DNA, 3975 bp, Homo sapiens
  Payload ID: 4920
  Gene Symbol: DLG4
  Gene Name: discs, large homolog 4 (Drosophila)
  Uniprot ID: P78352
  ENST ID: ENST00000399510
  CDS Start-End: 854-3157
gggacagaagaggaaggggcttaagtcactgcagccagagggatggaggtggactgaagggagggcttctccggtggggttagaagggaaaagtagggaaagagaagtgtaaggtagatggcagaggcagagacatggaaagacagactctagggttcctgatgaaatctatctcggccaacacaaaagggagggtacagtggtggggggcacccaagctagggtgtgagtaccctaagtgtattcttctgagatgtaggccattcactaactcttggaacagctacagtttcacagtaggaagacccccccagattcactgcccctcccttagtaaagcctctgagaccttcctgaacattcccttctgtctttgccctctgttccttccagagaccatgtgcccaggcagatggattcctcccgggcctgagaggaactgcaggaattctcctgcctcttacccgtaaaaccccaacttctctagccctagggcaggaagtcccaaacaatttctacccctttttctgcaattctcattggggtgagaggaggcccaggaggagagagagctgggctcagcttctttttgagctgctggagccctctgtgaggaggccctctttgctggcttctcaggagagcgtggctaggttctgcctgcctatgggaagagggggccagggtgtgtggagcaagatggtggcggtgctggtgccttgggacctgggggaatgggacagctggtcggctcagagacggcctactttactcacagctggaatttagtggggagaagcagctcaactccaatcctggaggattagggagattaaagtgagagaagagagagatgtcccagagaccaagagctcccaggtcagccctctggctcctggcacccccactgctgcggtgggcacccccactcctcacagtgctgcatagcgacctcttccaggccttgctggacatcctggactattatgaggcttccctctcagagagtcagaaataccgctaccaagatgaagacacgccccctctggagcacagcccggcccacctccccaaccaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcacctggacaatgagatcagtcacagcagctacctgggcaccgactaccccacagccatgacccccacttcccctcggcgctactctccagtggccaaggacctgctcggggaggaagacattccccgagaaccgaggcgaattgtgatccaccggggctccacgggcctgggcttcaacatcgtgggtggcgaggacggtgaaggcatcttcatctcctttatcctggccgggggccctgcagacctcagtggggagctgcggaagggggaccagatcctgtcggtcaacggtgtggacctccgaaatgccagccatgagcaggctgccattgccctgaagaatgcgggtcagacggtcacgatcatcgctcagtataaaccagaagagtacagccgattcgaggccaagatccacgaccttcgggaacagctcatgaacagcagcctgggctcagggactgcgtccctgcggagcaaccccaaaaggggtttctacatcagggccctgtttgattacgacaagaccaaggactgcggcttcctgagccaggccctgagcttccgctttggggatgtgctgcatgtcatcgatgctagtgatgaggagtggtggcaggcacggcgggtccactctgacagtgagaccgacgacattgggttcatccccagcaaacggcgggttgagcgacgagagtggtcaaggttaaaggccaaggactggggctccagctctggatcgcagggtcgagaagactcggttctgagctacgagacagtgacgcagatggaagtgcactatgctcgccccatcatcatccttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcaggggaagcactgcatcctcgatgtctcggccaatgccgtgcggcggctgcaggcggcccacctgcaccccatcgccatcttcatccgcccccgctccctggagaatgtgctagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcagggtctggggtcacccctgccctcatcgtaattccccatgttccttgatttctcatttattttttccactttttttcttctcaaaggtggttttttggggggagaagcaggggactccgcagcgggcccctgccttccacatgcccccaccatttttctttgccggtttgcatgagtggaaggtctaaatgtggcttttttttttttttttcctgggaatttttttggggaaaagggagggatgggtctagggagtgggaaatgcgggagggagggtggggggcaggggtcgggggtcgggtgtccgggagccagggaagactggaaatgctgccgccttctgcaatttatttatttttttcttttgagagagtgaaaggaagagacagatacttgaaa

SEQ ID NO: 127358 - DNA, 763 bp, Homo sapiens
  Payload ID: 4920
  Gene Symbol: DLG4
  Gene Name: discs, large homolog 4 (Drosophila)
  ENST ID: ENST00000447163
  CDS Start-End: 60-763
gaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggtaaacgcccccgagctggtgcacgtggcggagaggaacttgtcccacctcgaggctggccacggggtcgtgggccacgcccacctctcccccttcaaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggag

SEQ ID NO: 127359 - DNA, 926 bp, Homo sapiens
  Payload ID: 4920
  Gene Symbol: DLG4
  Gene Name: discs, large homolog 4 (Drosophila)
  ENST ID: ENST00000451807
  CDS Start-End: 83-926
cttggatcctctggtgatccaagccttcctaccagatatgaaactaggacattgggggtcatcttgggggcgcatgtaacagatgccgatcaacggggtcaatctcgcttggaaataccgctaccaagatgaagacacgccccctctggagcacagcccggcccacctccccaaccaggtaaacgcccccgagctggtgcacgtggcggagaggaacttgtcccacctcgaggctggccacggggtcgtgggccacgcccacctctcccccttcaaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatg

SEQ ID NO: 127360 - DNA, 1004 bp, Homo sapiens
  Payload ID: 4920
  Gene Symbol: DLG4
  Gene Name: discs, large homolog 4 (Drosophila)
  ENST ID: ENST00000485100
  CDS Start-End: 42-932
gtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctgtgagagcccttcaaacaccaaagttccccatgacccatcccgtttaacccatgacatgcagtcccacgacatccctgtagctgtccctcttcagatattccctatgaaatagccacaacctctgatccttgctgttgttggagaagagatggaaaatcaattaccataaaagaactagaaaaga

SEQ ID NO: 127361 - DNA, 586 bp, Homo sapiens
  Payload ID: 4920
  Gene Symbol: DLG4
  Gene Name: discs, large homolog 4 (Drosophila)
  ENST ID: ENST00000486626
  CDS Start-End: 240-586
gtggattgaggctgggcccttgagcagctctcagggtggcggagtgggcttggctaagaggctgaaagggtagccacgctgatgggaccctccgttatgggctccctctcgagtcaaggctcaggctgctttttgtctcttgttttcccaaacaggccaattctcccccagtgattgtcaacacagataccctagaagccccaggatatgagttgcaggtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagg

SEQ ID NO: 127362 - DNA, 573 bp, Homo sapiens
  Payload ID: 4920
  Gene Symbol: DLG4
  Gene Name: discs, large homolog 4 (Drosophila)
  ENST ID: ENST00000493294
  CDS Start-End: 299-573
actgcgtagggtgaggggcgtaggggagcgaggaaggcaggttattcaggatgcgctgcgcccacaaacctcttcagcccggcctcctctcggcctggctaacgtggggcggggcccagggcaggagaggcggggctagcggatcccttctgcgctcaggagtttggtcggccccaggccacgccccacccccctgttgtcctgacgacagggcctcctggaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaa

SEQ ID NO: 127363 - DNA, 869 bp, Homo sapiens
  Payload ID: 4920
  Gene Symbol: DLG4
  Gene Name: discs, large homolog 4 (Drosophila)
  ENST ID: ENST00000491753
  CDS Start-End: 1-257
ttgggcccaccaaggaccgcgccaacgatgatcttctctccgagttccccgacaagtttggatcctgtgttccccatacgacacggcccaagcgggagtatgagatagatggccgggattaccactttgtgtcgtcccgggagaaaatggagaaggacattcaggcgcacaagttcattgaggccggccagtacaacagccacctctatgggaccagcgtccagtccgtgcgagaggtggcagagcagagagattaacaagcggatcacagaggagcaagcccgcaaagccttcgacagagccaccaagctggagcaggagttcacagagtgcttctcagccatcgtggagggtgacagctttgaggagatctaccacaaggtgaagcgtgtcatcgaggacctctcaggcccctacatctgggttccagcccgagagagactctgattcctgccctggcttggcctggactcgccctgcctccatcacctgggcccttggtctggactgaattgcccaagcccttggctccccccggcctccctcccaccccttcttatttatttcctttctaactggatccagcctgttggaggggggacactcctctgcatgtatccccgcaccccagaactgggctcctgaacgccaggaacctggggtctgggggggagctgggctccttgttccgagcccttgctccttaggatccccgcccccacctgcccccaatgcacacacagacccaccgggggccacctgccctcccccatcctctcccacacacattccagaagtcagggccccctcgaggagcacccgctgcagggatgcagggccacaggcctccgctctctcctaaggcaggg

SEQ ID NO: 127364 - DNA, 7415 bp, Homo sapiens
  Payload ID: 4921
  Gene Symbol: DLG5
  Gene Name: discs, large homolog 5 (Drosophila)
  Uniprot ID: Q8TDM6
  ENST ID: ENST00000372391
  CDS Start-End: 7-5766
gccaccatggagccccagcgccgggagctgctcgcccagtgtcagcagagcctggcccaggccatgacggaggtggaagccgtgctcgggctgctcgaggccgcgggagcgctcagtcccggcgagcggcggcagctggacgaggaggcgggaggcgccaaggcggagctgctgctcaagctgctcttggccaaggagcgggaccacttccaggacctgcgggcggcgctggagaagacgcagcctcacctgctgcccattctctacctgaacggcgtcgtcgggccgccgcagcccgccgaaggcgcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 127365 - DNA, 4292 bp, Homo sapiens
  Payload ID: 4921
  Gene Symbol: DLG5
  Gene Name: discs, large homolog 5 (Drosophila)
  ENST ID: ENST00000424842
  CDS Start-End: 1-2643
ggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggggtcatccagggaggagccctgtcaagcatttgcactcagatcttggcaatggtcaatcaagaacaaaataaagtcctgtggattccagcctgcccgctctaggagaatgctgtgctgtggatgactgcagctggccgcctgaggggacaccagactcagctcttttctagcgactgaaagtagaagtctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggctgttttctaagttacaggcagagtgggactgagatggtacagtgtgcacagacaggtactgagctgacagactgggattttctgtactaaaatgttactttgtatcaaaagttaaacaggctttagtacaacaaataaaggtcaatttctgtaa

SEQ ID NO: 127366 - DNA, 5505 bp, Homo sapiens
  Payload ID: 4921
  Gene Symbol: DLG5
  Gene Name: discs, large homolog 5 (Drosophila)
  ENST ID: ENST00000468332
  CDS Start-End: 1-645
tcagccactgttctggacactcatgggaaacaagtggcctttgtcatgagctggtggacagagtgcgctgtcagcacgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcagagctgaccctaattccaaagggagtgttccatcgtcccagcttctggttctctaggctgcaaacgcttgataaaccaggctgccactgaatgagccaggtgattcctcggctgttggagctggaagggccagacaagctttcctggtctagcctgggcatttgaggaatccggaagctgaaacccagagaggtggagtgactcaccccagggctcagatcccatgaggtgttgaagcacaacgggtcatccgagattctcaacaaactgtatgacacggccatggacaagttggaggtggtcaagaaggactatgacgcccttcggaagaggtacagtgagaaagtcgccatccacaatgcagacctgagccgcctggagcagctgggggaggagaaccagcggttgctgaagcagacagagatgctgacccagcagagggacacggccatccagctgcagcaccagtgcgccctctccctgaggaggtttgaggcgatccaccatgagctgaacaaggccacggcgcagaacaaggacctgcagtgggagatggagctgctgcagtcagagctgaccgagctgagaaccacgcaggtgaagacagcaaaggagtcggagaaatacagggaggagcgggacgctgtgtacagcgagtacaagctcatcatgagtgagcgtgaccaggtcatctctgagctggacaagctgcagaccgaagtggagctggccgagtccaagctcaagagcagcacatctgagaagaaggcggccaatgaggagatggaggcgctgcggcagatcaaagacacggtgacaatggatgctgggagagccaacaaggaggttgaaatccttcgaaagcagtgcaaggctctgtgccaggagctgaaggaagccctccaggaggcggatgtggccaagtgccggcgggactgggccttccaggagcgagacaagattgtagcagagcgtgacagcatccggacactgtgtgacaacctgaggcgggagcgggaccgtgcggtgagcgagctggctgaggccctgcgcagcctggatgacacccgcaagcagaagaatgatgtcagccgcgagctgaaggagctcaaggaacagatggaatcccagttggaaaaggaggcccggttccgacagctgatggcccacagctcccacgactcggccattgacacggattccatggagtgggaaacggaagttgtagagttcgagagggagacggaggatattgacttgaaggcactggggtttgatatggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcgcagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgaagggcaggaagggcagggcagcagggtctcgatggccctgcccagcattgtcccctgtgccacaggatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaag

SEQ ID NO: 127367 - DNA, 7415 bp, Homo sapiens; identical to SEQ ID NO: 127364
  Payload ID: 4921
  Gene Symbol: DLG5
  Gene Name: discs, large homolog 5 (Drosophila)
  Uniprot ID: Q8TDM6
  ENST ID: ENST00000614211
  CDS Start-End: 7-5766

SEQ ID NO: 127368 - DNA, 4292 bp, Homo sapiens; identical to SEQ ID NO: 127365
  Payload ID: 4921
  Gene Symbol: DLG5
  Gene Name: discs, large homolog 5 (Drosophila)
  ENST ID: ENST00000632221
  CDS Start-End: 1-2643

SEQ ID NO: 127369 - DNA, 5505 bp, Homo sapiens; identical to SEQ ID NO: 127366
  Payload ID: 4921
  Gene Symbol: DLG5
  Gene Name: discs, large homolog 5 (Drosophila)
  ENST ID: ENST00000633108
  CDS Start-End: 1-645

SEQ ID NO: 127370 - DNA, 3167 bp, Homo sapiens
  Payload ID: 4921
  Gene Symbol: DLG5
  Gene Name: discs, large homolog 5 (Drosophila)
  ENST ID: ENST00000632417
  CDS Start-End: 1-1795
ccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggaacagaagtgtgtcccggccagtggagaactctccccggagctccaggagtgggcaccttactcgcctgggcattccagccggcacagcaaccccccgctataccctagcaggccgtctgtgggcactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgtttgtggccgaggtggaggatgacagtcctgccaagggtcctgacggcctcgtgccaggggacctcatcctggagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctggacgagaatgcccagaagatccagcgcgggcagattcccagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgaggctcctggcaagttctgcagatgtccccttgaggtgatgaaggcctcccagcaggccattgagcggggtgtcaaagattgcctgtttgtcgactataagcggagaagcggccatttcgatgtgaccactgtggcgtcaataaaggagatcacagaaaagaaccgacactgcctcctggacattgctccgcacgctattgagcggctccaccacatgcacatctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggtaggtgtgcgtgggcctggagtggggagcaggcagcagggaaggaagcagaggcttcctaaggctgttttcttagccgtggagaagcccgcactttctacatgctcccaagtgctgtcatgagcacgttcctgacaagtcaggtgttcagattgcagtccctggccaacgtcaggattcttacaggttgaatgttaagctcaccgatcttggcctcaggtcctgcctggcttgcctgctcattttcacacgtgcagtggtgggtctgtctcatagcacaggtgcagtttagtgcagccacagtgtccccaggcagggcggggactggagcagcccccagtgtgccagcagtgtgggcagcggaggctaggggcccatctgtccctagcaccctccagggcagtcccgttttgcagcgggatttggcaaacccccctccaaaaaaaaaaaaacaaaaaacaaaa

SEQ ID NO: 127371 - DNA, 4227 bp, Homo sapiens
  Payload ID: 4922
  Gene Symbol: DAAM1
  Gene Name: dishevelled associated activator of morphogenesis 1
  Uniprot ID: Q9Y4D1
  ENST ID: ENST00000360909
  CDS Start-End: 127-3333
ctacgagcggctgtgaaggaaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattact

SEQ ID NO: 127372 - DNA, 5806 bp, Homo sapiens
  Payload ID: 4922
  Gene Symbol: DAAM1
  Gene Name: dishevelled associated activator of morphogenesis 1
  Uniprot ID: Q9Y4D1
  ENST ID: ENST00000395125
  CDS Start-End: 24-3260
aagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaagggagctacaagttggcctgaattctacattgatcagctcaattccatggctgctagaaaatctctgctggctttagagaaggaagaagaagaagaaagaagtaaaactatagagagtttaaagacagcactgaggacaaaaccaatgaggtttgtaaccagattcatcgacttggatggcctatcatgtatcctcaactttctaaagaccatggactacgagacctcagagtctcgaatacatacttctctcattggctgtataaaggcgttaatgaacaactctcaaggccgggctcacgtcctggctcattctgagagtattaatgtaattgctcagagtctgagcacagagaacattaaaacgaaggtggccgtgctggaaatcttgggcgccgtgtgcctggttcccgggggccacaagaaggttctgcaggccatgctgcactaccagaagtatgccagcgaaaggacccgctttcagacattaattaacgacttggataaaagcactgggcggtatcgagatgaagtgagtctcaagactgccatcatgtccttcattaatgcagtgctcagccaaggtgcaggagtggagagtttggactttagacttcatcttcgctatgaatttctgatgttaggaattcaacctgtaatagataaattaagggaacacgaaaattcaacattagataggcatttagacttttttgaaatgctccgaaatgaagatgaactagaatttgccaaaagatttgaactggttcacatagacacaaaaagtgcaactcagatgtttgagctgaccaggaagaggctgacacatagtgaagcttacccgcatttcatgtccatcctgcaccactgcctccaaatgccttacaagaggagtggcaacactgttcagtactggctactactagatagaattatacagcagatagttatccagaatgacaaaggacaggaccctgactccacacctttggaaaactttaatattaagaatgtcgtacgaatgttggttaatgaaaatgaagttaagcagtggaaagaacaagcggaaaaaatgagaaaagagcacaatgagctacaacagaaactggaaaagaaagaacgagaatgtgatgctaagactcaagagaaggaagagatgatgcagaccttaaataaaatgaaagagaaacttgaaaaggagactactgagcataagcaagtcaagcagcaggtggcggacctcacagcacagctccatgagctcagcaggagggccgtctgtgcttcaatcccaggtggaccctcgcctggagcaccaggagggccctttccttcctctgtgcctggatctctccttcctcccccaccacccccacctctaccaggtgggatgcttccccctccaccgcctcccctccctccaggtggccctcctcctcccccagggcctcctcccttaggggcaatcatgccacctcctggtgctccaatgggcctagcactgaagaagaaaagcattcctcagcccacaaatgccctgaaatccttcaactggtctaaactgcccgagaacaaactggaaggaacagtatggaccgaaattgatgatacaaaagtcttcaaaattctagatcttgaagacctggaaagaaccttctctgcctatcaaagacagcaggatttctttgtgaacagtaactccaagcagaaagaagcagatgccattgatgacactctgagttccaaacttaaagttaaagagctttcggtgattgatggtcggagagctcagaattgcaacatccttctatcgaggttgaaattatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcagaagtgaaacctaaagtggaagcaattcgttctggctcagaagaggtgtttaggagtggtgccctcaagcagttgctggaggtggttttggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaacatgactgagctggacaaagaaataagtaccttgagaagtggcttgaaagcagtagagacagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaacaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattactaaaaaaaaaaaaaaaaaaaaaaaattaatggggtgcctttttgttatagtttctattttctgttttgtaggacaagctgcattttctgtaaatataggtctggactaaaggatacataaagaatgcacaaaatgtcaacatcagcagagatgcccagatctatttatctctaagtatatttgaagtgattgctgtttatatgttgtcattttaaaattgtgtgtcagtaaagctacctgtaaaatttcagtccaaaaaaataaagctctcagggagacatgaataaaatcaatgaacattagaaaataaaatatagatgcttaccattaacctaccaactcttaatatccttaaattatgtgatatataaagaggactgttacttttttacttttttttttttttttttttttttttggctttgctttatttatttgtagttgggggctaacgttttctcttttctttctattgatcctgttgtggttgggtttcctgtggagagagtagtttgtcctgttgcactagaacattatttactcactaaattgagtttttcagtcaattaacaaatatttattaagttcctactatgtaccaggcatagtagggctacaatggtaagcaagacagagtccctgcccccaaagagcttatattctaatggggatattaagggatgaatagaataccaatgtgtgcactgtacaggaatcatactatttaaaaataatttgtataaactataatgcttagcacagatggcgagttatctgtgctatgtgaaagctgtgaaatagtgctctaagagttgtcaagagctgtggttttacatcttttcctcattgcaaatttagtgactttctacacactatatggaaataaatgactagcaaataaaacagtcataaatacaaagcagaggttgcactcccccaatcccgagttaacccaggtctgcaataacaccatgttaaaggtgcagatagagacttggctcaaaaaggcttggagatgaggaagattggaatataatgatggttttgtctgttccttaactaaagtgcctctatgtatattcttttctatttgtagcaggataaatttggtctggctcagttttggaactgtattttgaaaatggctttgtcttacagtttaaggaatagacaggtggagggaaagtcacataaaggagcaagtttgtgtagctgtccctcttgccccttttaatcatcctcctttgatatggccatcctggtgggcctcctttgccatttccatttttggtttctttccctgaaaactgtgtgcaggtaattccatgtgccattgttgaaaagaaaaaaaaaaaacaaaaaaaaaacctactttttagattggtgctggtgtaagtagccacttttctctcttgggtgtgtattttaaactttttttgtttttttaaattaatgccaaaaagaaaatgcataatttgtaaacttaattatatgtcttatatcttattagcttagtagttggaaccacttagtctttaggtgcaagactgttgttagatagtactgagaaaaaaaaagtatgtgttatgagactgtacatgtttttttaaaaatagcaatatgcaataaagagatgaattcattgggtgtaca

SEQ ID NO: 127373 - DNA, 582 bp, Homo sapiens
  Payload ID: 4922
  Gene Symbol: DAAM1
  Gene Name: dishevelled associated activator of morphogenesis 1
  ENST ID: ENST00000556135
  CDS Start-End: 108-398
aaactgtttaaccggatcccattgtacccagagtgcagagccgcctttccagcatgcaggggctgctcagcgtttagtcacatcaagaaatagaacagaattcagccatggccccaagaaagagaggtggacgaggtatttcattcatcttttgctgtttccgaaataatgatcacccagaaatcacgtatcggctgcgaaatgatagcaactttgcgcttcagaccatggaaccagcattgcccatgccccctgtggaggagctggatgtcatgttcagtgaactggtggatgaactggacctcacagacaaacacagagaagccatgtttgcacttccagctgagaaaaaatggcaaatatactgtagcaagaaaaaggtaagattttcattgtgattatggttaactggaaaataatcattgattccatttgctcttccatttcaccactagaattggacagctctttgtaatatgaaaaccagattgaatgtgttatgttgtggctgtggtgctacatgtagccagtgtcaattccctggatgttgtttttgtcagtacttcattgggctcttttcca

SEQ ID NO: 127374 - DNA, 6194 bp, Homo sapiens
  Payload ID: 4923
  Gene Symbol: DAAM2
  Gene Name: dishevelled associated activator of morphogenesis 2
  Uniprot ID: Q86T65
  ENST ID: ENST00000274867
  CDS Start-End: 157-3363
gcttcccggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctaccc

SEQ ID NO: 127375 - DNA, 6224 bp, Homo sapiens
  Payload ID: 4923
  Gene Symbol: DAAM2
  Gene Name: dishevelled associated activator of morphogenesis 2
  Uniprot ID: Q86T65
  ENST ID: ENST00000398904
  CDS Start-End: 183-3389
aggaaaggggtccccggactctggggctctcagcacctgcggtcgcaaaccaacctcatgccctgactttaccaggcgtcgggactctgacttaaccggggaatgagggacttggtctggcggcagatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtc

SEQ ID NO: 127376 - DNA, 829 bp, Homo sapiens
  Payload ID: 4923
  Gene Symbol: DAAM2
  Gene Name: dishevelled associated activator of morphogenesis 2
  ENST ID: ENST00000405961
  CDS Start-End: 428-826
ctcgggtctcagcgatgccccctgtgtctcccacccctaggcctgcacagaggggactcagaggccgagataatttacttttgctttctttgccttttccagagcatagggggaaaccgtaatttaggcggctgctaagaatagctcccccaatcctggaaagagcgtgtgcttatttttgaaagtgctccttgtctctcccccagccctgcctgaggctcacagtacaagtcagtcaaattgttcagggcagcagtggtgtctggagacctggtttgagttcctaggttcatacctagcgtccttctgagcctcaagtttcttcgtctgtaaaaagagaagatgaaagtttgagataaacctcgaacatgatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggtgccctctctgacccctctggccacatctcagggttcatggcatggggtggctcttgctgccttggcatgctcatgcattcacctgatgtttattacatgccagccctgttctaggtgttggaggaacaacagtgaataaaat

SEQ ID NO: 127377 - DNA, 6247 bp, Homo sapiens
  Payload ID: 4923
  Gene Symbol: DAAM2
  Gene Name: dishevelled associated activator of morphogenesis 2
  Uniprot ID: Q86T65
  ENST ID: ENST00000538976
  CDS Start-End: 204-3407
gggcgggggaaggagcatctcaggaaaggggtccccggactctggggctctcagcacctgcggtcgcaaaccaacctcatgccctgactttaccaggcgtcgggactctgacttaaccggggaatgagggacttggtctggcggcagatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtgctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcct

SEQ ID NO: 127378 - DNA, 794 bp, Homo sapiens
  Payload ID: 4923
  Gene Symbol: DAAM2
  Gene Name: dishevelled associated activator of morphogenesis 2
  ENST ID: ENST00000494405
  CDS Start-End: 149-442
gggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaagccctgttctaggtgttggaggaacaacagtgaataaaatagaaaaaggaaattctgctgtcctggagcttacactcaaagaaataggattctctttttcaaaaacgcttaaagcaggacctgctgcatcccaggactggggcttgctgggagacagacaaagaagcagagtctggactctctcgtgcctgctcccaggcatggagggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccg

SEQ ID NO: 127379 - DNA, 3871 bp, Homo sapiens
  Payload ID: 4923
  Gene Symbol: DAAM2
  Gene Name: dishevelled associated activator of morphogenesis 2
  ENST ID: ENST00000633794
  CDS Start-End: 225-3458
agacgcctgacgtcagagcggggcgggcggacgggcgcgaggccgggcctggaggggcggcagccgcggcttcccggggatagcgcggagcacgcagcagcgagcggagcgcgggcggcggcgccgtacctcgggctgcgggagcgcgggcgccctggggtcctcggaatcacaatgaggacctagggcatctgtctgctgacgccccctggcctgcagtgaccatggccccccgcaagaggagccaccatggcctgggcttcctgtgctgcttcgggggcagtgacatccccgaaatcaacctccgggacaaccaccctctgcagttcatggagttctccagccccatcccgaacgcagaggagctcaacatccgctttgcagagctggtggatgaattggatctcactgacaaaaaccgagaggctatgtttgcactgccccctgagaagaaatggcagatctactgcagcaagaagaaggagcaggaggaccccaacaagctggcaaccagctggcctgactattacatcgaccgcatcaattccatggctgcgatgcagagtctgtacgcgtttgatgaggaggagacggagatgaggaaccaagtcgtggaagacctgaagacagccctccggacacagcctatgaggtttgtgacccgcttcattgagctggagggcttgacctgtctgctaaatttcctccggagcatggaccacgccacctgtgagagccgcatccacacctcactcattggctgcatcaaagcattgatgaacaactcccaggggcgggcacatgtgctggcacagcctgaggccattagtaccatagcccagagcctacgcacagagaacagcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaagatgttttcagcctaccagaggcaccaggagctgataactaatccttctcagcagaaagagctgggctccactgaagacatctacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagctgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccc

SEQ ID NO: 127380 - DNA, 3239 bp, Homo sapiens
  Payload ID: 4924
  Gene Symbol: DVL1
  Gene Name: dishevelled segment polarity protein 1
  Uniprot ID: O14640
  ENST ID: ENST00000378888
  CDS Start-End: 286-2373
gggcggcggggctgagcgcgccctccgtgctgcgtccctcgcgccgctcccgggccgggggcggatgggcggccgcgggccgcggggcagcagtcgggacgcgcgcgggagccgggggcggcggccggggcctgggcggtcgggcgggggcgcccgggggcctcggagcgtcggggccgagagcggtgcgggccgggcggggcgcaggcgggcgggcgggtagcgccccgcgtccgagccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccaaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacggtacgagtccctgctccagcgccgtcacgcgcaccagctcctcctcactaaccagctccgtgcctggtgctccacagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatgggaca

SEQ ID NO: 127381 - DNA, 2926 bp, Homo sapiens
  Payload ID: 4924
  Gene Symbol: DVL1
  Gene Name: dishevelled segment polarity protein 1
  Uniprot ID: O14640
  ENST ID: ENST00000378891
  CDS Start-End: 48-2060
ccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccaaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagcacaaacgccggcggaggaagcagcgccttcggcaggcggaccgggcctcctccttcagcagcataaccgactccaccatgtccctcaacatcgtcactgtcacgctcaacatggaaagacatcactttctgggcatcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatgggaca

SEQ ID NO: 127382 - DNA, 2268 bp, Homo sapiens
  Payload ID: 4924
  Gene Symbol: DVL1
  Gene Name: dishevelled segment polarity protein 1
  ENST ID: ENST00000610709
  CDS Start-End: 71-1405
gcgggtagcgccccgcgtccgagccccgggccgggccctgagcgcgcgggctccgcgccgccgccgcgccatggcggagaccaagattatctaccacatggacgaggaggagacgccgtacctggtcaagctgcccgtggcccccgagcgcgtcacgctggccgacttcaagaacgtgctcagcaaccggcccgtgcacgcctacaaattcttctttaagtccatggaccaggacttcggggtggtgaaggaggagatctttgatgacaatgccaagcttccctgcttcaacggccgcgtggtctcctggctggtcctggctgagggtgctcactcggatgcggggtcccagggcacggacagccacacagacctgcccccgcctcttgagcggacaggcggcatcggggactcccggcccccctccttccacccaaatgtggccagcagccgtgacgggatggacaacgagacaggcacggagtccatggtcagtcaccggcgggagcgtgcccgacgccggaaccgcgaggaggccgcccggaccaatgggcacccaaggggagaccgacggcgggatgtggggctgcccccagacagcgcgtccaccgccctcagcagcgagcttgagtccagcagctttgtggactcggacgaggatggcagcacgagcaggctcagcagctccacggagcagagcacctcatccagactcatccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggg

SEQ ID NO: 127383 - DNA, 778 bp, Homo sapiens
  Payload ID: 4924
  Gene Symbol: DVL1
  Gene Name: dishevelled segment polarity protein 1
  ENST ID: ENST00000631679
  CDS Start-End: 1-756
gacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacgagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagccttagactgaaggactagcggagcggaccttg

SEQ ID NO: 127384 - DNA, 785 bp, Homo sapiens
  Payload ID: 4924
  Gene Symbol: DVL1
  Gene Name: dishevelled segment polarity protein 1
  ENST ID: ENST00000632445
  CDS Start-End: 1-654
atcgaccccgccgcctggctgtcccacacggcggcactgacaggagccctgccccgctacggtacgagtccctgctccagcgccgtcacgcgcaccagctcctcctcactaaccagctccgtgcctggtgctccacagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagccttagactgaaggactagcggagcggaccttgggccgggagcaaaagcagtgggtccacccggagcagccgccgggccccgggccgtgagaaggagcgtcgggcggcgggagctgggggcagtggcagtgaatcggatcac

SEQ ID NO: 127385 - DNA, 3018 bp, Homo sapiens
  Payload ID: 4925
  Gene Symbol: DVL2
  Gene Name: dishevelled segment polarity protein 2
  Uniprot ID: O14641
  ENST ID: ENST00000005340
  CDS Start-End: 284-2494
aagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactcc

SEQ ID NO: 127386 - DNA, 992 bp, Homo sapiens
  Payload ID: 4925
  Gene Symbol: DVL2
  Gene Name: dishevelled segment polarity protein 2
  ENST ID: ENST00000574143
  CDS Start-End: 119-992
caaggcctagataggaccggcgggggctttgctagagtggattgggcgacatggaggggcacacgtctactttgggccacactgggattttctggcctatggtggagcagattgtactatgctgagggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcactgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccct

SEQ ID NO: 127387 - DNA, 900 bp, Homo sapiens
  Payload ID: 4925
  Gene Symbol: DVL2
  Gene Name: dishevelled segment polarity protein 2
  ENST ID: ENST00000575086
  CDS Start-End: 1-900
tgaactttgagaacatgagcaacgatgacgctgtgcgggtgctgagggacattgtgcacaagcctggccccattgtgctgactgtggccaagtgctgggatccctctcctcaggcctatttcactctcccccgaacctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctc

SEQ ID NO: 127388 - DNA, 2659 bp, Homo sapiens
  Payload ID: 4925
  Gene Symbol: DVL2
  Gene Name: dishevelled segment polarity protein 2
  ENST ID: ENST00000575458
  CDS Start-End: 57-2249
aggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcat

SEQ ID NO: 127389 - DNA, 1136 bp, Homo sapiens
  Payload ID: 4925
  Gene Symbol: DVL2
  Gene Name: dishevelled segment polarity protein 2
  ENST ID: ENST00000575756
  CDS Start-End: 47-1136
agccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcactgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaa

SEQ ID NO: 127390 - DNA, 5254 bp, Homo sapiens
  Payload ID: 4926
  Gene Symbol: DVL3
  Gene Name: dishevelled segment polarity protein 3
  Uniprot ID: Q92997
  ENST ID: ENST00000313143
  CDS Start-End: 249-2399
gccgcggccaccggaagagtcgcggtcgccagtccagtcgggagagtggggagcggaagcggcggccgcggcggcggcgggcggcgctgggacccggtagcggccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaatttaccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattatt

SEQ ID NO: 127391 - DNA, 1099 bp, Homo sapiens
  Payload ID: 4926
  Gene Symbol: DVL3
  Gene Name: dishevelled segment polarity protein 3
  ENST ID: ENST00000423300
  CDS Start-End: 439-1099
acttgcctgccgcctcactaactgggcgctgggcctggaggcggtggggaaggcccctccaggcctgaaggctgcctctccagccctagcctgaggcctgcactgctctttggagctgaggccccacagccaagaggagacattcttctccccagtgttcatctgtctggcttctctcccaagcccctggcccacctagcactaggaagcaagcaccttctgtctaatgcctggcatgttttgctgtcaccttctgccctggaactcagggttggatgagcccctgaaatcatagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattg

SEQ ID NO: 127392 - DNA, 2294 bp, Homo sapiens
  Payload ID: 4926
  Gene Symbol: DVL3
  Gene Name: dishevelled segment polarity protein 3
  Uniprot ID: Q92997
  ENST ID: ENST00000431765
  CDS Start-End: 77-2176
gccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggaccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaat

SEQ ID NO: 127393 - DNA, 559 bp, Homo sapiens
  Payload ID: 4926
  Gene Symbol: DVL3
  Gene Name: dishevelled segment polarity protein 3
  ENST ID: ENST00000435708
  CDS Start-End: 79-312
gcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggctgcctgccctctcctttgtgggctgttgtgggtgttgtcaccggaacagagagcctgacccctgcggagtagtcctcactgacccagagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccatctcttccctgcagccctcatgctggtgggggcagccagg

SEQ ID NO: 127394 - DNA, 2571 bp, Homo sapiens
  Payload ID: 4927
  Gene Symbol: DACT1
  Gene Name: dishevelled-binding antagonist of beta-catenin 1
  Uniprot ID: Q9NYF0
  ENST ID: ENST00000335867
  CDS Start-End: 25-2535
gctctcgctgcccgactgggggccatgaagccgagtccggccgggacggcgaaggagctggagcctccggcgccggcccgaggcgagcagcgcacggcggagcccgaggggcgctggcgggagaagggcgaggcagacaccgagcggcagcgcacccgggagcggcaggaggccacgctggccgggctggcggagctggagtacctgcgccagcgccaagagctgctggtcaggggcgccctgcgcggcgccgggggtgcgggagccgctgcgccccgcgctggggagctactgggggaggcggcgcagcgcagtcgcctggaggagaagttcttggaggagaacatcttgctgctaagaaagcaattgaactgtttgaggcgaagagatgctggtttgttgaatcagttgcaagagcttgacaagcagataagtgacctgagactggatgtagaaaagacatctgaagagcacctggagacagacagtcggcctagctcagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcagatctcataggattgttggaatataaagaaggccactgtgaagaccaggcctcaggggcagtttgccgttccctctccacaccacaatttaattcccttgatgtcattgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttt

SEQ ID NO: 127395 - DNA, 3734 bp, Homo sapiens
  Payload ID: 4927
  Gene Symbol: DACT1
  Gene Name: dishevelled-binding antagonist of beta-catenin 1
  Uniprot ID: Q9NYF0
  ENST ID: ENST00000395153
  CDS Start-End: 148-2547
ctcgagggcttctagccaccgtccccgccagcgccgcgccccgccacagggcggcatgagcccacccgcggccgcagccctagcgccctgctcctccgcctgggcggcccggctgcggtgacggctctcgctgcccgactgggggccatgaagccgagtccggccgggacggcgaaggagctggagcctccggcgccggcccgaggcgagcagcgcacggcggagcccgaggggcgctggcgggagaagggcgaggcagacaccgagcggcagcgcacccgggagcggcaggaggccacgctggccgggctggcggagctggagtacctgcgccagcgccaagagctgctggtcaggggcgccctgcgcggcgccgggggtgcgggagccgctgcgccccgcgctggggagctactgggggaggcggcgcagcgcagtcgcctggaggagaagttcttggaggagaacatcttgctgctaagaaagcaattgaactgtttgaggcgaagagatgctggtttgttgaatcagttgcaagagcttgacaagcagataagtgacctgagactggatgtagaaaagacatctgaagagcacctggagacagacagtcggcctagctcagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtataatactttaatggaatgctttttaaaaaaatataaaaccaaggtaaattattgtttcatcttcacgtatggatgctagtgcctttaatggaaggtaaagaatgttttgctagttagaagtacatattgaggttttaatggtggtgatagtgagttttgtggcaccagctgttttttattttaaactttctgagcatccggcaaggtacaggttttgatgttcaagttttattgggataagatcttttgatcccaaggtcaggtggatggaatttttggatttatatttgttccttgagtcttcagggcagtgtctccatgagggttttcctgttgaggggcaccacatacaatagtgtgaagtaggtatgaggggcagtcattgtattctatagtttttttatgtagtctacatttctcagatgtatccccattcggttttattctcagaactgttactagactcatgacttggaggccaaaccttaaatccagagatagcagcctcgatagggaccttaaaaggattcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgctgttaagtttgttatttgggtataaaaccagatgtttacacctgtaaa

SEQ ID NO: 127396 - DNA, 993 bp, Homo sapiens
  Payload ID: 4927
  Gene Symbol: DACT1
  Gene Name: dishevelled-binding antagonist of beta-catenin 1
  ENST ID: ENST00000421793
  CDS Start-End: 604-993
ggaggaagcaggagcctcttgaaaaacttaccaccaaacttcatggaatcaccctggccttcttcaacaaaaacctctttaacagcactaaaacacagctaaaagaactgtttgaggcgaagagatgctggtttgttgaatcagttgcaagagcttgacaagcagataagtgacctgagactggatgtagaaaagacatctgaagagcacctggagacagacagtcggcctagctcagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcagatctcataggattgttggaatataaagaaggccactgtgaagaccaggcctcaggggcagtttgccgttccctctccacaccacaatttaattcccttgatgtcattgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatggg

SEQ ID NO: 127397 - DNA, 2610 bp, Homo sapiens
  Payload ID: 4927
  Gene Symbol: DACT1
  Gene Name: dishevelled-binding antagonist of beta-catenin 1
  ENST ID: ENST00000541264
  CDS Start-End: 814-2481
gagtcgcctagttctaacgttcggtctccttagttagatgagtatatgccctctccccagcggtttgcaaactcccacttaaaataccattttatttggaggttttcttgactttatctcctcccgccgagaggggccaaaagccaaggagggggtttgtggcgtgcttaactgtccagggccgagttttacgattacactggagcgcctgtagggagccgtgcctctccgagagctctccccagcatgccagctttcacccaggctggtgcttaatttcaaatagaagccctttgtataaggcagctcaaactagatggaaatgatggaaatttggctggagactgtgtcccctcctctcatattttatacgttctgccagctgtgattggtggtggaggtgggagaaaagagaacctgctctcgaactgtttgaggcgaagagatgctggtttgttgaatcagttgcaagagcttgacaagcagataagtgacctgagactggatgtagaaaagacatctgaagagcacctggagacagacagtcggcctagctcagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtataatactttaatggaatgctttttaaaaaaatataaaaccaa

SEQ ID NO: 127398 - DNA, 2239 bp, Homo sapiens
  Payload ID: 4927
  Gene Symbol: DACT1
  Gene Name: dishevelled-binding antagonist of beta-catenin 1
  ENST ID: ENST00000556859
  CDS Start-End: 506-2173
acagtgctctgcaggaggaagcaggagcctcttgaaaaacttaccaccaaacttcatggaatcaccctggccttcttcaacaaaaacctctttaacagcactaaaacacagctaaaagaactgtttgaggcgaagagatgctggtttgttgaatcagttgcaagagcttgacaagcagataagtgacctgagactggatgtagaaaagacatctgaagagcacctggagacagacagtcggcctagctcagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaa

SEQ ID NO: 127399 - DNA, 2942 bp, Homo sapiens
  Payload ID: 4928
  Gene Symbol: DACT2
  Gene Name: dishevelled-binding antagonist of beta-catenin 2
  Uniprot ID: Q5SW24
  ENST ID: ENST00000366795
  CDS Start-End: 90-2414
ggaggacccgcgacacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgaggttgcgcgcggcgttcgcggggctgcaggagctgcaggggctgcgagccacgcagcaggagcgggtacggggcgccctggccctgcagcccccgcccgcgcccgccgcgccctgcggcccccacggcctccacggccccgagcagcagctggaggcggcgctggccgcgctgcaggagcagctgtcccggctgagacaacaggacatcggcctgaagacccacctggaccagctggacctgcagattagcaagctgcagctggatgtgggcacagcctcaggggaggccctggacagcgacagcaggcccagctcaggcttttacgagatgagcgacggtggatcctgctccctgtccacgtcctgtgcctccgtctgcagtgaccacatctctccctcgctgggcagtttgttgcctgtggcccaggcccacaaggccaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacaggtgatcttgacagagccctgccggcggacacggggctccagaaagccagcgcggacgccgagctcctcgggctcctctgccagggggtggatatcccgctgcacgtgccggaccccaagtatcggcaggacctggtgtcccagggcggcagggaggtgtacccgtaccccagccccctgcacgccgtggctctacagagccccctgtttgtcctgactaaggaaaccccacagagaggtggcccctcgttccctagggagagccccaggggccccgcaggtctgaacaccatccagactgggccggtcctcgaggctggcccggccagggccagagcttatatcgacaggttgctgcatctgtggggccgggagaccccagcaaagggtagcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactggacaggcctgagggagcccatgcagccccccagccatccctggagtgggaccctgcccactggcccacagggaggggcgggctccagcggaggccagccctggcctgggaggcacccgggcgctcctgttctgagtccaccctctaccccatgcctgtcctcgtccccttggcagtggccccgcaggagagccaccggacctcagcccaagccctgttcccctttgaggcgtcactgctcacctcagtggccaggaggaagcatcgccgctggcagtccaccgtggagatctcggcccgggcccgcctggccagctgtcctgagtctaacctggggccccccaggcccgtggccaggagagcaggtggcccactggcccggggccgtccctcactggtccgccaggacgcctacaccaggagcgactcagagccctccaagcactcggccgagtgtgacccgcggttcccgtcagtcatcccggagaccagcgagggagagtccagtgaccacaccaccaaccgattcggagaccgtgagtccagcagcagcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaagacttccatgcggagctctggtttcagatgccagcagcctccccggccgacctagtgtctcttttcaaggtctgcccaggatgctgcttcccggcatgcaccttgtttccatgttgtcatcctcccatggcttcccctgccctcactcccctctggctggggaagtgtttcccaatcctttgaccattcctccccaaaagcattttaaagaggcggttgcaggactctgagctggaaattgaatttgagtttaaactccacgttaagctgtcagcatacacaaacacccaaattatgccatgatctcaaataaaaggaacattttttttccctcttttaa

SEQ ID NO: 127400 - DNA, 2028 bp, Homo sapiens
  Payload ID: 4928
  Gene Symbol: DACT2
  Gene Name: dishevelled-binding antagonist of beta-catenin 2
  Uniprot ID: Q5SW24
  ENST ID: ENST00000366796
  CDS Start-End: 122-964
ctgcggagccgggggcggagagaggaggcgcaggaggacccgcgacacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgaggttgcgcgcggcgttcgcggggctgcaggagctgcaggggctgcgagccacgcagcaggagcgggtacggggcgccctggccctgcagcccccgcccgcgcccgccgcgccctgcggcccccacggcctccacggccccgagcagcagctggaggcggcgctggccgcgctgcaggagcagctgtcccggctgagacaacaggacatcggcctgaagacccacctggaccagctggacctgcagattagcaagctgcagctggatgtgggcacagcctcaggggaggccctggacagcgacagcaggcccagctcaggcttttacgagatgagcgacggtggatcctgctccctgtccacgtcctgtgcctccgtctgcagtgaccacatctctccctcgctgggcagtttgttgcctgtggcccaggcccacaaggccaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacagagctgtgcaatgctccaggtgaacttgacatgcatgctccgcctgcaggctgcacctccagttcactgacaggtgtaggttctggtttgagaggaaagtgtggcctctgtggctgtcagctccctttctgctcagtgaacacaagttcaaagacaaaatcatcaggaatttcaagacagcaatgacagagcactacaccaagctgggggctgcattgactgaccagtcacaggctggaagtcgggtcctggccacaggcccagcttcttctcccgatatcatcggcccccctctgcccgccaagtcactctgctttccccacagtgagccagtgggagctgcagagaagtgtccagaaaggactgctggtcagtggaatttcctttacgtggaaagttgaagtgagggagtaatggacgtaagagagaatggtttctccctaacaaatagactggaaattccaatccttctactttctgtgtgtttttctagcatgactgcaagtgctggggccataagcaccatgttcagcagcacccaggaagcaaaagtagttgacagaatgttagtgagcattccttcttgtttttatttttttttaaagccccttctatatttcataatttttgtgattttgggtaaatacaatgttatcataagttaaggaaaagttaatctttttaggctaggaaaagttccagtttacgtgcatatatattattgcaaaatgatgtgaaaatttaatattttttgagataattgatatttttcattcactatgttaataagatgaatcatattaacaaaatgtccattgctaaaccaatcatgcattcataggatgaacaatgtttggttatggtgtttttgtttgtacttttaaatggtacttaaacataattagggagaagatgagctccaaagcacctggcacagctccagcaggctcagctaatggccggtcttctcatttaccaaacccacgtggccaccccgacctcagacgaattttttttacaaagtccagacattcaattatttacaatgtgtctttttaggacactgccagaattaggttgtaaatttttttttaggattgtatcttatgttcatagaagaaattggcctatgaaatttctttcatataatactcacatctggttttcatcccaaagctaaaccagcccataaaagcagctgtgatggttttcttcttcttatatttcaataaatggtatgtaaaagacag

SEQ ID NO: 127401 - DNA, 1620 bp, Homo sapiens
  Payload ID: 4928
  Gene Symbol: DACT2
  Gene Name: dishevelled-binding antagonist of beta-catenin 2
  Uniprot ID: Q5SW24
  ENST ID: ENST00000607983
  CDS Start-End: 311-1411
acacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactggacaggcctgagggagcccatgcagccccccagccatccctggagtgggaccctgcccactggcccacagggaggggcgggctccagcggaggccagccctggcctgggaggcacccgggcgctcctgttctgagtccaccctctaccccatgcctgtcctcgtccccttggcagtggccccgcaggagagccaccggacctcagcccaagccctgttcccctttgaggcgtcactgctcacctcagtggccaggaggaagcatcgccgctggcagtccaccgtggagatctcggcccgggcccgcctggccagctgtcctgagtctaacctggggccccccaggcccgtggccaggagagcaggtggcccactggcccggggccgtccctcactggtccgccaggacgcctacaccaggagcgactcagagccctccaagcactcggccgagtgtgacccgcggttcccgtcagtcatcccggagaccagcgagggagagtccagtgaccacaccaccaaccgattcggagaccgtgagtccagcagcagcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaagacttccatgcggagctctgg

SEQ ID NO: 127402 - DNA, 2088 bp, Homo sapiens
  Payload ID: 4928
  Gene Symbol: DACT2
  Gene Name: dishevelled-binding antagonist of beta-catenin 2
  Uniprot ID: Q5SW24
  ENST ID: ENST00000610183
  CDS Start-End: 65-1879
acacagctcgggatccgcgcgcgctgggcctccggcgccgctcgtggggttcgggaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacaggtgatcttgacagagccctgccggcggacacggggctccagaaagccagcgcggacgccgagctcctcgggctcctctgccagggggtggatatcccgctgcacgtgccggaccccaagtatcggcaggacctggtgtcccagggcggcagggaggtgtacccgtaccccagccccctgcacgccgtggctctacagagccccctgtttgtcctgactaaggaaaccccacagagaggtggcccctcgttccctagggagagccccaggggccccgcaggtctgaacaccatccagactgggccggtcctcgaggctggcccggccagggccagagcttatatcgacaggttgctgcatctgtggggccgggagaccccagcaaagggtagcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactggacaggcctgagggagcccatgcagccccccagccatccctggagtgggaccctgcccactggcccacagggaggggcgggctccagcggaggccagccctggcctgggaggcacccgggcgctcctgttctgagtccaccctctaccccatgcctgtcctcgtccccttggcagtggccccgcaggagagccaccggacctcagcccaagccctgttcccctttgaggcgtcactgctcacctcagtggccaggaggaagcatcgccgctggcagtccaccgtggagatctcggcccgggcccgcctggccagctgtcctgagtctaacctggggccccccaggcccgtggccaggagagcaggtggcccactggcccggggccgtccctcactggtccgccaggacgcctacaccaggagcgactcagagccctccaagcactcggccgagtgtgacccgcggttcccgtcagtcatcccggagaccagcgagggagagtccagtgaccacaccaccaaccgattcggagaccgtgagtccagcagcagcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaagacttccatgcggagctctgg

SEQ ID NO: 127403 - DNA, 2526 bp, Homo sapiens
  Payload ID: 4929
  Gene Symbol: DACT3
  Gene Name: dishevelled-binding antagonist of beta-catenin 3
  ENST ID: ENST00000300875
  CDS Start-End: 442-1656
ctcactcagacccatgaggccctgcctggtctcgtctgggacctgggacagcagctgggagacctgagcctggagtctgggggcctggaacaggagagcgggcgtagctcgggcttctatgaagatcccagctctacaggaggtccagattcaccaccctcaaccttctgtggggacagtggcttctctggatccagctcctatggtcgcctgggtccctctgagccccggggcatctatgccagtgagaggcccaagtccctaggagacgccagtcccagcgctccggaggtggtgggcgcgcgggcagcggtgccgcggtccttctcagcgccctacccgacggcaggggggtccgccggcccggaggcctgctcctcggcggagcggcgggcccgcgccgggccctttctgacgcccagccccctgcacgccgtggcgatgcgcagcccgcggccctgcggccgccctcccaccgactcgcccgacgcggggggcgcagggcggcccctggacggctacatctcggcgctcctgcgcaggcgccgccgccggggggcgggccagccccggaccagtcccgggggcgcggacggcggcccgcggcgccagaacagcgtgcgccagcggccgcccgacgcgtctccgtcccccggcagcgcgcgacccgcgcgggagccctcgttggagcgcgtcgggggccaccccaccagccctgccgccttgagccgcgcctgggcgtcgtcgtgggagtcggaggcggcacccgagcccgctgcgccgcccgccgccccctcaccccccgacagcccggctgagggccgcttggtgaaggcgcagtacatcccgggcgcgcaggcggccacccgaggcctccctggccgcgccgcccgccgcaaaccgccgccactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgtgagtttggggatttgcttgggctcccccttcatggcctctgcacctccacactcccaaccactgacccttccacatctaccttccaaagaccatcgttttctctgcttccaaagacccccctcactctccccactcctaacagtcttggttgaaaaggctcccccaccaccaccgagaggaatggggaggagccctgtttgacccagttcagcttctagcttggaagcccttgggcaagacagttccccttctctgggcgtcactttcctcatctgtacagtaagtgtccatgtatgcaaaaggggtaattcggtttgaatttccccgttttagtttagaagcctagtctgtttgttcccctccaccgctctccctctcattcctgatgagccctctcattcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacata

SEQ ID NO: 127404 - DNA, 2834 bp, Homo sapiens
  Payload ID: 4929
  Gene Symbol: DACT3
  Gene Name: dishevelled-binding antagonist of beta-catenin 3
  Uniprot ID: Q96B18
  ENST ID: ENST00000391916
  CDS Start-End: 75-1964
gctggggcggggaggtgggaccgggagaggggtggccgcggggcccggccgggctggggcggggggccgcagccatgatccgggccttctcgttcccggtgagccctgagcggggccggctgcggggctggctggagggtagcctggccgggctctgcgagttacattggctccgggagaggcaggagtaccgcgtgcagcaggcgctgcggctggcccagcccggaatggggggcgccgaggccgaggacgaggaggacgccgatgaggatgaagatgcggcggcggcgcgccgggccgcagcggccctggaggagcagctggaggccctgcctggtctcgtctgggacctgggacagcagctgggagacctgagcctggagtctgggggcctggaacaggagagcgggcgtagctcgggcttctatgaagatcccagctctacaggaggtccagattcaccaccctcaaccttctgtggggacagtggcttctctggatccagctcctatggtcgcctgggtccctctgagccccggggcatctatgccagtgagaggcccaagtccctaggagacgccagtcccagcgctccggaggtggtgggcgcgcgggcagcggtgccgcggtccttctcagcgccctacccgacggcaggggggtccgccggcccggaggcctgctcctcggcggagcggcgggcccgcgccgggccctttctgacgcccagccccctgcacgccgtggcgatgcgcagcccgcggccctgcggccgccctcccaccgactcgcccgacgcggggggcgcagggcggcccctggacggctacatctcggcgctcctgcgcaggcgccgccgccggggggcgggccagccccggaccagtcccgggggcgcggacggcggcccgcggcgccagaacagcgtgcgccagcggccgcccgacgcgtctccgtcccccggcagcgcgcgacccgcgcgggagccctcgttggagcgcgtcgggggccaccccaccagccctgccgccttgagccgcgcctgggcgtcgtcgtgggagtcggaggcggcacccgagcccgctgcgccgcccgccgccccctcaccccccgacagcccggctgagggccgcttggtgaaggcgcagtacatcccgggcgcgcaggcggccacccgaggcctccctggccgcgccgcccgccgcaaaccgccgccactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgtgagtttggggatttgcttgggctcccccttcatggcctctgcacctccacactcccaaccactgacccttccacatctaccttccaaagaccatcgttttctctgcttccaaagacccccctcactctccccactcctaacagtcttggttgaaaaggctcccccaccaccaccgagaggaatggggaggagccctgtttgacccagttcagcttctagcttggaagcccttgggcaagacagttccccttctctgggcgtcactttcctcatctgtacagtaagtgtccatgtatgcaaaaggggtaattcggtttgaatttccccgttttagtttagaagcctagtctgtttgttcccctccaccgctctccctctcattcctgatgagccctctcattcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacata

SEQ ID NO: 127405 - DNA, 3085 bp, Homo sapiens
  Payload ID: 4929
  Gene Symbol: DACT3
  Gene Name: dishevelled-binding antagonist of beta-catenin 3
  ENST ID: ENST00000410105
  CDS Start-End: 75-620
gctggggcggggaggtgggaccgggagaggggtggccgcggggcccggccgggctggggcggggggccgcagccatgatccgggccttctcgttcccggtgagccctgagcggggccggctgcggggctggctggagggtagcctggccgggctctgcgagttacattggctccgggagaggcaggagtaccgcgtgcagcaggcgctgcggctggcccagcccggaatggggggcgccgaggccgaggacgaggaggacgccgatgaggatgaagatgcggcggcggcgcgccgggccgcagcggccctggaggagcagctggaggccctgcctggtctcgtctgggacctgggacagcagctgggagacctgagcctggagtctgggggcctggaacaggagagcgggcgtagctcgggcttctatgaagatcccagctctacaggaggtccagattcaccaccctcaaccttctgtggggacagtggcttctctggatccagctcctatggtcgcctgggtccctctgagccccggggcatctatgccagtgagaggcccaagtccctaggtaaggtgggtgagggtggggccctggggccagggaaaggacagtaggaggatggttgtgggcacagacttccgaatcgggcctggattccaattccagctgtgacatttccttttcacatggttatgagcaggtctcttatttctgggtctctgtttttccatctgttaaaatgaaatatggctgggtgcggtggctcacgcctgtaatcccagcactttgggaggtgggcggatcacttgaggccaggagattgagaccagcctggccaacatagtgaaaccccgtctatacaaaaattagttgggcgtggtagcgaacacctgtaattccagctactcgggaggctgaggtgggaggatcgcttgaacctgggaggtggaggttgcagtgagccaagattgtgccactgccctccagtctgggtgacagagcaagactctgtctcaaaataaataaataaataggctgggcacagtggctcatgcctgtaatcccaacactttgggaggccaaagcaggtggatcacctgagatcaggagttcgagaccaacctgaccaatatggtaaaatcctgtctctactaaaaatacaaaacttagctaggcgtggtgatgtgtgcctgtagtcccatctactctgaagactgaaacaggagaattgcttgagccctggaggtggaggttgcagtgagccaagatggagccactgcactctagccagggtgacagagtgagactccatctcaaaaaataaataaataaatataaaatggtataataacagtgcctcaatagccaggcattgtggtgcatgcctgtatcccagctacttgggaggctgagccaggaggattgcttgaacctgggaggcagaggttgcagtgagctgagatggtgtcactgcgctccagcctgggtgacagagcaagactctgcctcaaaaagataaaaataaaacaccaaccacacacacacacacacacacacacacacacacacacacacacacacaaacagtgcctgccctaaggggatatttttgaatattcagtgagcctctgctctaaggcattggacttggtgcatggcagtcactggtaaacaggaactgctgtcattcattcatacaagtaagtttttgagcccccactatgtgctacctagcagtatcccaggagcaatgaacaaaatgaacagtaatgaacaaaacaggcaaatccctgccctcaggaaactgccagcctagttggaggaatagataaaatacaggataaatggccaggcgcggtggctcatgcctgtaatcccagcactttgggaggccgagacgggcagatcacgaggtctggagttccagaccagcctgaccaacatggtgaaaccccgtctctacaaaaaatacaaaaattagctgggcgtggtggcgcgtgcctgtaatcccagctactcaggaggctgaggcaggagaatcgcttgaacctgggtggcagagattgcagtgagctgagatcatgccactgcactccagcctgggtgacagagcgagacttcgtctaaaaaataaataaataaataaataaataaataaatagataaataaataaaccaggataaataagtaaaatatctagggtacgaaataatgccatgtgctatgacaagaaataagccggggaaagggactcagaagtgtccctttgagtttggggagggaagtgcaattttagaaaatatggctggggagggcttcactgagactgtaacatttgagttgtgccctgaactaagtgggggagtggacctagcagatatccagaaggaagagcattccgggcatctggaatctggaatgggaagcagaaaggctctgaggccagaatgtgactggcgcctgctttcaggaggccagtgtggctggagtcctataagtagaggagaagggtcagctcagtggttcatgcctgtaatcccagcactttaggaggctgaggcgggaggattatttgagcctgggagctggagactagactgggcaacacagtgagaccccatccctacaaaaaataaaaaaatcagcagggcatggtgatgcgttcctgtagtcccagccgttcaggaagataaggcgagaggatcccttgagcccaggagctggaaactgcagtgagctatgattgcgccactgcactccagcctgggtgacagagcaagcaagaacctgtcttaaaaaaaaaaggccaggcgcagtggctcacacctgtaatcccagcactttgggaggccgaggcgggaggatcacgaggtcaggagatcgagaccatcctggcgaacacggtgaaaccccgtctctactaaaaatacaaaaaaattagccgggcgtggtggcgggcgcctgtagtcccagccactcaggaggagaatggcatgaacccgggaggcggagcttgcagtgagccgagatcgggctactgcactccagcctgggcgacagaacgagactccgtctcaa

SEQ ID NO: 127406 - DNA, 4762 bp, Homo sapiens
  Payload ID: 4930
  Gene Symbol: DISP1
  Gene Name: dispatched homolog 1 (Drosophila)
  Uniprot ID: Q96F81
  ENST ID: ENST00000284476
  CDS Start-End: 165-4739
attcagtctgtcctgccgctctgtggagctgcgcctgccaactcattgctttctgctgtgctgtgatcctgcagtcagttgccgctgttgctactgcaatcatttgcaccaaactgagccagagaagttccctcttttaacataaagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataagaccatccagacctttcaagttgccaaaaagttatgcagccctgatagccgactggccggtggtggtcttgggcatgtgcaccatgttcatcgtagtctgtgccttggttggagtattagtgccagagctccctgacttctctgatccattgctgggttttgaaccaagaggaacagcaataggccagagattggtcacatggaataatatggtgaaaaatacaggatacaaagcaacattagcaaattatccctttaaatatgcagatgaacaagccaaaagccatcgggatgatagatggtcagatgatcattatgaaagagagaaaagagaagttgactggaacttccacaaggacagctttttctgcgacgttccaagtgaccgatattccagagtggtatttacttcatctggaggggagacattatggaatttacctgcaattaaatcaatgtgcaatgtagataattccaggatcagatctcatccccagtttggtgatctctgccagaggaccactgctgcctcctgctgccccagctggacactgggaaactacatcgccattctgaacaatagatcgtcctgtcagaaaatagttgagcgagacgtttctcataccttgaagctgcttcggacttgtgccaaacactaccaaaatggcactctggggccagactgctgggacatggcagccagaagaaaggaccagctcaagtgcaccaatgtgccacgcaaatgtaccaagtacaatgctgtgtaccagatcctccattacttggtggacaaagactttatgaccccaaagacggctgactatgccacgccagctttaaaatacagcatgctcttctctcccacagagaaaggggagagcatgatgaacatttacttggacaactttgaaaactggaactcttctgacggcgtgactaccatcaccgggattgagtttggtatcaaacacagtttgtttcaggattatcttctaatggatactgtgtatcctgccatagccattgtgattgtccttttagttatgtgtgtctacaccaagtccatgtttatcactctgatgacaatgtttgcaataatcagttctttgattgtttcctattttctctatcgtgtagtatttcacttcgaattttttccttttatgaacctcactgccctcattattttggttggaattggagcagatgatgcttttgtcctgtgtgatgtttggaactacacaaaatttgataagcctcatgccgaaacctcagaaacagtaagcatcaccttgcagcacgctgccctctccatgttcgtcaccagttttaccactgctgctgccttttatgctaactatgttagcaacattacagcaatccgatgctttggggtttatgcggggacagctatattggtgaattacgttttgatggtcacatggcttccagcagttgttgtgctgcatgagcggtatcttcttaatatattcacttgcttcaaaaagccccagcagcaaatatatgataacaaaagctgctggacagtggcttgccagaagtgccacaaagtactctttgccatttcagaagcatctcgaatttttttcgaaaaagtattgccatgcattgtcattaagtttcgctacctttggctgttttggttccttgccttaactgtaggtggggcctacattgtatgtataaatccaaagatgaaactgccctcactggagttatccgagttccaggtgttccggtcgtcccatccttttgagcgttatgatgctgaatacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgcccagatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcagaa

SEQ ID NO: 127407 - DNA, 12614 bp, Homo sapiens
  Payload ID: 4931
  Gene Symbol: DISP2
  Gene Name: dispatched homolog 2 (Drosophila)
  Uniprot ID: A7MBM2
  ENST ID: ENST00000267889
  CDS Start-End: 88-4293
cgccgccgctgccgccgccaccgccgccgccgccgccgccgccgcggcttcagcaccagcgcccggacagcggtgccgcccacgggcatggacggtgacagcagcagcagcagcggcggcagcggtccggctcccggcccgggtccggaaggggagcaacggcccgagggggagcccttggccccagacggcggctccccggacagcacccagaccaaggctgtgccccctgaggcaagcccagagagaagctgctccctccacagctgccccctggaggacccttccagctcttcaggacccccaccaacaacttccaccctccagcctgtgggtccatccagccccttggcccctgcccacttcacctatccccgggcactgcaggaataccaggggggcagttccctgccaggacttggggatcgggcagctctctgctcccacggctccagcctcagcccttctccagccccctcacagcgcgatgggacctggaagccacccgctgtgcagcaccatgtggtcagcgtcaggcaggaacgagccttccagatgccaaagagctattcccagctgattgctgagtggccagtggccgtgctgatgctgtgtctggctgtcatcttcctctgcaccctggctggactgttgggggcccggctgcccgacttctccaagcctttgctgggctttgagccacgggacacagacattgggagcaagttagtggtctggagagcactacaagccctcacaggccccaggaagctgcttttcctttccccagaccttgagctgaacagctcgagctcccacaacactctgaggcctgcacccagaggcagtgcccaggagagcgctgtccggcctcggagaatggtggagcccctggaggacagaaggcaagagaacttcttctgtggcccccctgagaagagctatgcaaagctggtgttcatgtccacctcctcgggcagcctatggaacctgcatgccatccattccatgtgtcgcatggaacaggaccagatccgctcccataccagcttcggggctctgtgccagcggacagcagccaaccagtgctgccccagctggtccctgggcaactatctggctgtgctctccaaccgctcctcctgcctggacactacccaagctgacgcagcccgcacactggccctgcttcggacctgtgccctctactaccacagtggcgccttggtgccctcttgtctgggacctgggcagaacaagtccccacgctgtgcccaggttcccaccaagtgctcccagagtagtgccatctaccaactcctgcactttctgcttgacagggactttctgagtccccagaccactgactaccaggtgccttccctcaagtacagcctgctcttcctgcccaccccaaagggtgcttccctcatggacatctacctggaccggctggccaccccctgggggcttgctgacaactacacctctgtcactggcatggacctgggcctcaagcaggagctgctgaggcacttcctggtccaggacacggtgtaccccttgctggctctggttgccatcttcttcggcatggccctgtacctgcgctcactcttcctcacgctcatggtgctgctgggggtgctgggctcactgctggtggccttcttcctttaccaggtggccttccgcatggcctacttccccttcgtcaatctggcagccctcctcctgctgagcagcgtctgcgccaaccacacgctcatcttcttcgacctgtggcgccttagcaagagccagctgccgtcgggggggctggcgcagcgcgtgggccgcaccatgcaccacttcggctacctgctgctggtctccggcctcaccacgagcgcggccttctatgccagctacctgagccgcctgccggccgttcgctgcctcgccctcttcatgggcacggctgtgctggtgcacctggcgctcacgctggtctggctgcccgcctccgccgtgctccacgagcgctacctggcgcgcggctgtgcgcgccgggcgcggggccggtgggagggcagcgcgccccggcggctactgctggcgctgcaccggcggctccgcggcctgcggagggcggcggctggcacctcgcgtctgctcttccagcgcctgctgccctgcggcgtcatcaagttccgctacatctggatctgctggttcgcagcactggcggcagggggcgcctacatcgccggagtcagcccccgcctgcggctgcccacgctgccgccgcccggcggccaggtcttccggcccagccaccccttcgagcgcttcgacgcggagtatcgccagctgttcctgttcgagcagctgccgcagggcgagggcggccacatgcccgtggttttggtgtggggcgtcctgcctgtggacactggcgaccctctggaccctcgtagcaacagcagcctggtgagggaccctgccttctcggccagcggccctgaggcccagcgctggctgctggcactctgtcaccgggcccggaatcagagcttcttcgacaccctgcaggaaggctggcccacgctgtgtttcgtggagaccctccagcgctggatggagagccccagctgcgcccgcctggggcctgacctctgctgcggccactcggacttcccctgggccccccagtttttcctgcactgcctgaaaatgatggctctggagcaaggccccgatggcacccaggacctgggactccgctttgatgcccatggcagcctggccgccctggtcctacaattccagaccaacttccggaacagtccggactacaaccagacccagctcttctacaatgaggtcagccactggctggcagcggagctgggcatggcacctccaggcctccgccgtggttggttcactagccgtctagagctgtatagcctgcagcacagcctgagcactgagcctgctgtggtgctgggcctggctttggcgctggcctttgccacactgctcctgggcacctggaatgttcccctcagcctattctccgtggcagctgtggcaggcaccgtgctgctcactgtaggactcctggttctcctcgagtggcagctcaacactgccgaggccctgtttctctctgcctcagtgggcctctcagtagacttcactgtcaactactgcatctcctatcacctgtgcccacaccctgaccgcctgagccgtgtggccttctctctgcgccagaccagctgcgccacagccgtgggggctgcagccctgtttgcggcaggcgtgctcatgctgcctgccacagtgctgctctatcgcaagctgggcatcatcctcatgatggtcaaatgcgtcagttgtggctttgccagcttcttcttccaatctctctgctgtttcttcgggccagagaagaactgtgggcagatcctctggccctgtgcccacctgccatgggatgctggtactggggaccctggtggggagaaggcaggccgcccacgaccagggtcagtgggagggatgcccgggtcctgctcagagcaatatgagctacagcccctggcacggcgtcggagccccagctttgacaccagcacagccaccagcaagctgtcccaccggccctcagtactctctgaggatctgcagctccatgatggtccgtgctgttcccggcccccaccagcccctgcctccccaagggagctgctgctggaccaccaggcagtcttcagccagtgccctgccctgcagacctcctccccctataagcaggctggccccagccccaaaacccgggccaggcaggactcccaaggggaggaggctgagcccctgccagcctcaccagaagccccagcccactctcctaaggccaaggctgcagatcctcctgatggcttctgttcctcagccagcaccctggaggggctcagcgtctctgatgagacctgcctaagcacctctgagcccagtgcccgtgtaccagattccgtgggtgtgtccccagatgacctggatgacactgggcagccagtccttgagcgaggccagctcaatgggaagcgggacaccctgtggctggcgctgagggagacagtgtatgacccatcattgcccgcttcccatcacagcagcttgtcctggaagggccgaggggggccaggggatggcagccctgtggtgctgcccaatagccagccagacctgccagatgtttggctgcgcaggcccagcactcacacgtcaggctatagcagctgagggggacccggggaggctggacagggcgcggaaccctgtcatggatgacaaggcaagggcagcaataggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattctccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgcacattttagtctccttggaatctatctcactacttcactacagggtagcctgacattggtcaggttcttttgacacccaatttataggtaaagacattgagactaagtaagatgaactgacctcagggtcacttagccactaaatggcagagcggtttcattccaccactacaacctccagtttccctttggctacctgccttctttcaccgctagcaccctcctccaatctgctttctctggtgtctctgactgaatccagccaccctctttgggcctccacttcctgagagagctgtattccaaaaaaacccaggagttcctctccatctcccccgtgcctccctctggaatctggctgagatgtctgctggccctggggcgtcctagctgacctgattcccaggcttcaggaccgtgcctcttctacagccacagtgtataagaggccccaccagaagaggtactgaggggcagaagaggtgaagccaaatccaatcaaggcaggaactcagacctgccctttgggaagtgtatgagtctgaagctgcttcccaggttagggtccccagctttttaaggacaagtctctctgtggagcgttaagcagaccaaaggctggttcctccttcccaaacttcctggtagggaagttttatcccatgtgagagctcatgacaccaggtggcatcaacatgtttattgaacacctactttgcatatggtattacaaggggacagaggtgtggaagaaaaattgaacaccaccctcaaagagctcaccttctagctggggagacagcttatgcacacatgcaggcatcggatggctcacggacggcaccatatgcctgccatcatcattattgttggagctcaagtacccaggactgggtaacaagaaaggctttctggaggaggaaaaacttgagctgggcttcagaagaccaagcgtctcagactggaaggggccttggcgatcgtttattccagcagttttcaaattttgtagcctcaggactctttcttcaaagaagctctgtgtggaaaaacaatatataaaacaggtaaaaggcagctactctggtgggcgctgggtgttgggggtggagtcagcttagcctgtctttccactgcagcctctccgggtatctggggaacccctccggctcctggcagcttcacagaatgtaatatgaaagctactgatccaggctattttacagaggagtatcaggaaagggaagggattgttctagggccaaatagtctgtggcagagctggaggcaaatcagatgatgtttttgttttatttagttttttattattgagacctacttcctactccaagtagcccatgagaagtggagcagaaaccgaaaagagacatgggagttgtggaagagacagaaggcaataggcaggtacggcaggataccttggctcctttgcaagataagtaaatcaagatgagtaactcctgacaccaggaaggggaagctggaacctaatttgaacctgtccccagggggtctgctgggacctctctcttcatgtccaggtagcattcggcctctctgacctagagctgctcatcagccctggtttctctgataatggtgtccctctgtcatcatgcagccaggctgagagagccctggtatcctcagggacaatgagccacagggaggttaagggaactcttcctcccaagcatgagcagaagacactttgcctgaacataaccactgaaatgttagaatgcagaggggtggatgggtgggcatgagggatctgagcacacccgagggccctacctggggatttccaggtcatattcttgcaggctgtggccacacaacacttcaggaaggtgaatgagccatagcagctgatgcattgattagatttgttctttatgttgccaggcccagaagaacccagcagtaatctaaaacattaccttatacctagaatggcccaaaccaacagcaggcaatccacatcagcaggaaatccagcctgcctctctagccctgactttggaatgtggaacttaaagcacttcctatttcctttgagttgcagcagatcctttgctttattattattaggggcacttacaatgagtgtatggccctggagacatggcttacaagcacgctgtgaggcgtacaaaaatgagtcaaagcacttatgcttgccctgcaaaattcaagaaatgatttctccccactcagacactctaatagaactacattaacatttggaacttgaggtcatttcccctatttgtgccactgatccttgaactcacattctgagtacgagtatgtatcctgtatgctattaaaatataacttgaggccggacatgatggctcatgcctgtaatcccagcactttgggaggctgaggcaggtggatcactagacgttaggagtttgagaccagcctggccaacatggtgaaaccccgcctctactaaaaatacaaaaattagttgggcgtggtgggggatgcctgtagtcctagctacccaggaggctgaggcaggaaaatcatttgaacccgggatgcagaggttgaagtgagccgagatcgtgccactgcactccagcctggatgacagagcaagacaccgtctcaaaaaataaataaataaataagtcgggcacggtggctcacgcctgtaatcccagcactttgggaggccaaggcaggtggatcatgaggtcaggagatcgaaaccatcctggctaacatggtgaaaccccgtctctactaaaaatacaaaaattagccgggtgtggtggcgggcgcctgtagtcccagctactcgggaggctgaggcaggagaatgatgtgaacccaggaggcagagcttgcagtaagccgagattgcgccactgcactccagcctgggcaacagagcgagactccatcttaaaaaaaaaaaatatatatatatatatatgtaaacttgatatagtctgttaccatgggaaaaccatccttccatggctgtggtgatttggggacttttagagtgacagtgttagacagactgattttattggctgaatcttagattttactgatatatagcatatcccataccatgatatgcgggcaatattccagcttgagacaattttttttttttttttttgagacagagtcttgctctgtcgcccaggctggagtgcagtggcacaatttcggctcactgcactaattttttgtatttttagtagagacagtagagtatttttagtgttagccaggatggtctcgatctcctgacctcatgatccgcctgcctcggcctcccagagtgctgggattacaggcatgagccaccgcgcctggccgagacaatttttaaaaagacatttctcaagagagttataagccaaaatttccctagccccctccaactcattctgtccttctcccagtgcatgtcaggacagggaagaaggctttaaatcagattttaagaaagaggatacattggtttacaacctttgcctatcgtccagagagtttctgatcttttctttttttttgagacggagtcttgctctgtcgcccaggctggagtgtagtggcacgatcttggctcactgcaagctctgcctcccaggttcacgccattctcctgccccagcctcccgagcagttgggactacaggcacctgccaccacgcctggcaaattttttgtatttttagtaaagacggggtttcattgtgttagccaggatggtttcgatctcctgaccttgtgatccgcccacctcggcctcccagagtgctgggattacaggtgtgagccactacacccggccctgatcttttctttgacggtggcagtatctcattttttgataatacacatgggtaatggcaagctcttgggaccccatgccaagcatcaagatcccatttacctggtgataggaaagacagacattcctcaccctttctacccacacccttgttcacagggatgactgtaactaaggtctgcaggtatttatgcttaggagaagaaatcgtagttcaattcaccaggaatatgagaaacaaaagaaagccactatgtgctatgtaaatgtctggccatccaaagccaccttatgcagaggaacactggaagggccttgataaatttctcataattattatcgggcctctttgtgattactcacatttttctcaatataggggaaagatcagcattttaccaaatccacaaccatcaaacaaacaagagctttaatattgctaaagaaaatcacacagctgagcagattgatgtagatttgaattcatgaccacctatcttaactggaccctcagctctgcctagctagtattcattctagctactagttttgattatttgtattgactcttttatattttctccaccttcctcaaatatctcaccttcccccacccctcagtggacaaaaaaaaaaaaaaaattcttcatgaagaaaactgaagccttcaaatagaaatttcctcaccttcaaggcaccaaagccacaacttacctacccccgctcctgcctgctcctctccccatcccttctgctacaacgaaggaagcagtaatggctccatcaatggcttctcacacttggtgtcagaggccttcacacgagggtttgcactcccctacaaggacatgaagactttctagaaggtaggtggacacagatagttttaaagtaatcagtttccagagccgccttctccatatgttcccctccttatattggtgggcctaagaagccacaggcctgacagctgtccttcccaacttccactttcccagttgcctcccctccctcattctgaatcctactctggctccttgctctgcgctgtaaaaaacaaataaaagggccacttgagaatgctctgcttgaggaagtccttgaaagagcaaagcctggagagcttctttgagaaagttcacaggggcagccctgtggctcagttctgtgccttcttcatttaagaattcaaattcattgacatgttatattgtaaaatatataaatatatattaaaaaggaaaaaataataaaaatttttaaaaataattcaacttcaggtgagacacagtggctcatgcctataatcccagtgttttgaaaggctgaagtgggaggatggcttgaggccaggagtttgagaccagcttgggcaacatagcaagatcccgtatctacaaaaaataattttaaaaattagctgggcatgggccgggcgcggtggctcacgcctgtaatcccagcactctgggaggccgaggcaggtagatcatctgaggtcaggagttcaacaccagcctggccaacatggcaaaaccctgtctctactaaaaatacaaaaattagccgggcgtggtggagcatgcctgtagtcccagctactcaggaggctgaggaaggacaatcgcttgaaccctggaggcagaggttgcagtgagccaagatcatgccattgcactccagcctgggtgacagagcgagactacatctcaaaataaataaataaataataaaataaaaataaaaattagctgggcatggtgatatgcgcctgtagacccagctactccagaggctgaagcaagaggatcacttgaactctggagttcgaggttacagtgagccataatcacattatggcactccagcctggcaacagagcgagaccttaactctaaaaaaagaaataaagaagaatttaaactgaaagtgagatggttgacacaggatacatattaaccacattgatttgaatggaaaaataaaatcagactttttctgttagaaggtcagaattggctcacaggtttgacagagaggatagtctttgcaagtaggatgtatggtggacattttccctaaaatggaataactttaatctgcagctccacagtttgaacaaaaacagactgaaggctgggcgtggtggctcatgcctgtaatcccaacactttgggaggcctaggcgggcagatcacgaggtcaggagatcgagaccatcctggctaacatggtgaaacctcatctctactaaaaatacaaaaaaatagctgggcgtggtggcgggcacctgtagtcccagctactcaggaggctgaggcaggcgaatggcgtgaacccgggaggcggagcttgcagtgagccgagattgcgccactgcactccatcctgggcaacagagtctcaaaaaaaaaaaaaaaaatttttgactgaaagtacagatacaacttccctttccagccaagatggaggagcaggggccaagtttatcctcctgcctgaaacaaccaaccaaacagtaaatacatgaaataatgagtttcaagacactggacatgaggtaacaaaagacagtgatctctcagaggcaagaaacaaacaaggagaacccctcggttgcccagcttaccgcttgagaggatgtatttcacggagggagaacccaggcaaagcaagtgactctgaggtgaggggatagctgggagtgtggagcagccaagctggctagagtgctcaggacagggtactggagaggagaaaggtggatatatagagaattctggggatctgcaaagggccccccttgagtgttccacagagcatgattcatcatataagtgtaaggaaaccacttgagacaaaggaaaggaccacccaaaacaatgggccggaacagtagccagaagtcacacacagcctggaccacgcctgtccccatcagccagattggaaaacctcaaatttatggagcattggtcagaggtctcagaagggccttgcctcgtagtggggattcattagccctagtttaaacattgctggaacctacctaacaaatctcaaaagcaagacctgaattcaggaatcaagctgtttctaagtaactgaagtgtatcccagaacaaaacccaagaacattaacagaaatccaaaattaacgagcacccaaaaatgtaaaattcacaatggctggttttccaataaaaaattaccagtcatgcaaactataacccatcataaggagaaaaatcagttgaaaccactacagctgacacctatgtgagaattagacaaggacactaaaagaattattataactgtattccatatgtactaagtagagactaggaagatatttttaaatacccactttgaattttagagacgaaaactaaaatgtctgagatgatggggtgggtggggtaggcagaaagaggaggatgggaagaagtaccaaggggaaggaggaatgatttggggatgacggctgtgtttattatcttaattgtggtgatggtttcacaggtatatgtaatttctaaacttatcaaattgtacacttaaaatatgtggtctatggaatgttaattatatctcaataaagctgttaaaattgtactgaaacaaaaccattgggggaaactgggtaaagagtccaaaggacctccctatactatcattgtaacttcctgtcaattataacgattccaaaataaagaatttaaaagtgt

SEQ ID NO: 127408 - DNA, 1037 bp, Homo sapiens
  Payload ID: 4932
  Gene Symbol: DIRC1
  Gene Name: disrupted in renal carcinoma 1
  Uniprot ID: Q969H9
  ENST ID: ENST00000308100
  CDS Start-End: 272-586
tgacatgggcagagtttctcttgcccttaaagtcttactttccacttctaaataccttccaagatgttttcctccacaaacacaatatcttccttaaaagatagaccctgcatcagttgttaagctaacacatctttctcctcactacaaatgtatcactattgaatttctctccacaagtgtgaagatggctggagtagaaattctggcattgcttctcatcaccagaaggaaaaattcagagaaacagcccgaccacccaccctgacaaatgcctgaggcccacatgcagcctgcaaaactgcaaacatcactgcccaccacagaccacggaagcaagaagcctgtttcctgttacttgccaccactcagcaatgcccaccccatgtgtatagaggtccagaatgctcaaaattgttcttctgctgctgcaacattggagccttccatcatctcagacacatgcttttataaaccaataacaaaggatcaactttcttctaggtctgaattgaatactgtgaggctaaagtgtcttaactcattgagggggtggaaaatattaaaccaactaagccttacctaattacaatgccctgctgctgctcatctccctttattcgtttgtactcatactcaaaagaggttgtgtttttttcccttcattcaataacgattttccttgattcttagataagtccattccataatgtactccttaactgttctgaatttctttcagagaaaaactggaaaagacattaaatcatgttgaaatatttgactgactttcatctaggaaaaaatataaagttaaatctctacactaaaatataaacaaaataaaaagaaatttcagtaagaccaaaacatttacttttaaaaacctatatcatgttatatgtataactgaggaatgtaatcataattttgatttgtagaactgaagacaatatcaagtaaccctcaaaatgtaaattcaagaaacaaggtagttacgttagcctgcattaaaataaaaatatctgtgtgacaat

SEQ ID NO: 127409 - DNA, 3596 bp, Homo sapiens
  Payload ID: 4933
  Gene Symbol: DIRC2
  Gene Name: disrupted in renal carcinoma 2
  Uniprot ID: Q96SL1
  ENST ID: ENST00000261038
  CDS Start-End: 399-1835
tttaacttggacacttcctccaaacaccccagggttccttgcccaacctcctcgaatacagcctctctgggagtttccctctccccgactcagccgcgctggtccctgccttttcagcgctacctgccctccgtctgggacctggctcctttcctctcgccggtgtttcctcgccacccgcggaggggagggcggaccccagcctccttgccgcctgccccgcctccccgcctccccgccggcccggctcgggccgcgcaggcgcaccaggcgcggtccggaggccgagggcgaccacagcagcctccgcctcctgctgctcaggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagaggtctccggataactgtgctcctgacatccttccttatggttttgggaactggtctaagatgcatacctatatcagacttaatccttaaaagaagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcatgtgcatttttagttggaccacttgttgttccagctcccaatgggacatcacctcttcttgctgcagagagcagcagggcgcatattaaagatcgcatagaggctgtgttatatgcagaatttggagttgtctgcttaatattttctgcaacactagcttatttcccaccccgacctcctcttcctcccagtgttgctgcagctagccagcggctgagttatcggagaagcgtttgtagattattaagcaattttcgatttttgatgattgctttagcatatgccataccacttggtgtatttgctggctggtctggagttctggacttaattttaacaccagcgcatgtcagccaagtagatgctggctggattggattttggtccatagttggaggctgtgttgttggaatagctatggcaaggtttgcagattttatcaggggtatgctgaaactaattcttctcctcctgttttcgggagctacactgtcatccacgtggttcaccctgacctgtttgaacagcatcacacacctacctttaaccacagtgacattgtatgcctcctgtattctcctgggagtgttcttgaatagcagcgtgcctatattttttgagctttttgtggaaactgtctacccagttccagaaggaattacttgtggagttgtcacttttttaagtaatatgtttatgggagtacttttattttttctcacattttatcatacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaattccattaggatctagcactttgttacaagtgaaatgacaagtcacatggacatactgtgtcttctgcctgtatatggtggcatgagatgtaatgtccagagccaacaattatttaccagggttagattttattcagtgacccttgtttaaaaataataatttatcacattgaaactttcagctctgtcgaatgatttctgaattacatcctgtgtttcagcttaggttgtaaaatactccgttctctgtggagtcagcatatttgagagggcagcgttttgccagtacctatcttctttctacagaagatagctttttaagaaataagagttccacattgagtggctgtcagacacagatttcactgtgacgtaaaatacactgcagtgagaatatggtatcaccactattcatatttacatcattcccctcacacagaaaaaccaacccttttcccaaaaagtcaagaatactgctatacctttattattctcagcttcctccagcccttcttgtttttcctcacttgaaattgaaccttcattgtcagctaagtatatatacttttgtgttttcctggacagagtgcaagtggctcttatcagccaaggtggtgaaggttcaggaaagctgggcagcactgggccctgctcctctctgcacctgtgtgcgccatgacacacccacatgcagattcccaagtctgtctcccctcccccttagcaagtacaaggctgtgcattaactcacctcggtcctagaggagtatcctagtactgcttggcaacttctaagaccctaacttgtgaaactagggaagtaagaaaccgttcaaatttaacatctgtcttcagtcatctttaaatcgtctctctttataaacactctgctcacttagcagaaggactgaaggaactaaggaacttgctaaagagaagaagaaaacaaaagctagacttagttccagttaattctgttattcttctgaaataaaaatgaaataaaaggaa

SEQ ID NO: 127410 - DNA, 1822 bp, Homo sapiens
  Payload ID: 4933
  Gene Symbol: DIRC2
  Gene Name: disrupted in renal carcinoma 2
  ENST ID: ENST00000477647
  CDS Start-End: 110-457
ggcgaccacagcagcctccgcctcctgctgctcaggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcatgtgcatttttagttggaccacttgttgttccagctcccaatgggacatcacctcttcttgctgcagagagcagcagggcgcatattaaagatcgcatagaggctgtgttatatgcagaatttggagttgtctgcttaatattttctgcaacactagcttatttcccaccccgacctcctcttcctcccagtgttgctgcagctagccagcggctgagttatcggagaagcgtttgtagattattaagcaattttcgatttttgatgattgctttagcatatgccataccacttggtgtatttgctggctggtctggagttctggacttaattttaacaccagcgcatgtcagccaagtagatgctggctggattggattttggtccatagttggaggctgtgttgttggaatagctatggcaaggtttgcagattttatcaggggtatgctgaaactaattcttctcctcctgttttcgggagctacactgtcatccacgtggttcaccctgacctgtttgaacagcatcacacacctacctttaaccacagtgacattgtatgcctcctgtattctcctgggagtgttcttgaatagcagcgtgcctatattttttgagctttttgtggaaactgtctacccagttccagaaggaattacttgtggagttgtcacttttttaagtaatatgtttatgggagtacttttattttttctcacattttatcatacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataa

SEQ ID NO: 127411 - DNA, 552 bp, Homo sapiens
  Payload ID: 4934
  Gene Symbol: DIRC3
  Gene Name: disrupted in renal carcinoma 3
  ENST ID: ENST00000423123
  CDS Start-End: 104-499
atatgtgtccaggtgcctacgcaggtgcctgaccctgggcaagtcgctccgtcatgcggacctcagttttctcatctgtccgacgaaggaatccgggcagaacatgaattctcagaactggtgggactttccaaccagttgcttctcatgcagaggcagaaaaatgaggggatcaacagcccaggcctcaggggcacccttcttggcccttacagtcctggatcaagaatctgtcattcagattattccagagcccctgccccagttctacttatgcctcctggatgctgagctgacaggcgtggtgagggggggtgaagatgcctctgctactcctagatccttgagccactccctggccaactgtatgatctctgaaaatggattggtttccagattgacagccttggaaactggactcctctgtttttcctgcaaacaggtatcgcctgtgagctgcaggtggaggcagaacatggtgttcaagcccaactcctgattctccacggcttggggtaggtgtgggagggtgagggaacattgggaatgcca

SEQ ID NO: 127412 - DNA, 2706 bp, Homo sapiens
  Payload ID: 4935
  Gene Symbol: DISC1
  Gene Name: disrupted in schizophrenia 1
  ENST ID: ENST00000295051
  CDS Start-End: 54-1697
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 127413 - DNA, 2636 bp, Homo sapiens
  Payload ID: 4935
  Gene Symbol: DISC1
  Gene Name: disrupted in schizophrenia 1
  Uniprot ID: Q9NRI5
  ENST ID: ENST00000317586
  CDS Start-End: 54-1163
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggagctggaaccaattgctttggatccaccatggaagcctcgacatcctgaaccaaactcctattaatgaaacttcccaaatttaaacaaagcaagacaaatagatatccacacagcgtagatcatgacttctttagacatcatgaaaagaaaaagaggacccacgtggaagaatacgctcatttatgatcagggtagcatcatattcctctcccttttaacattatttcaggatagcagctgtctggatgctggccatgggcttgaaaaaaaccaggtgggcatttctgcccactgtaccgtttctcccatgcgtttcccagtcccctgtcatggcatgaaaaaaccgctattgttctgtgttgggacaattagatttttgtaggggggagaaaccacccaaaagcaaatggaaaaatatgctatgattaatgtcagttacgggaattaaacttcggaggcctttaggacaattatgaaggaatcattttccccttggtggcaatatgtactacagttgtcccttgatatccatgggggattaattccaggacgcctgtggatacagaaatccacgtgtactcaagtcttgttttcagtggatatgaaaagtcggccctccatatctgcaggttttacacttggcgaatgctgtatttttgattcatgttggattaaggatctggaacccctgatacagactgtatttattgaaaaaaaagtctgcctatgagtagactcacatgttaaaacccgtgttgttcaagggtcaaccataactgcaggcagaacatctgggcaggaagctcctgcaggaagacctgtaaactcaggtctgtggaacggcgatgatcttcttcccttgcttccagaattattgctgtgagatcaggtgcactggctacgaccttactctttgtgcagaacttatttctggtctggtttaagtgaacgttattctttctgtgcagtcctgtggttacatcaaaggttaaatttcatatagcatgtctgttatatcagacttctctgatggcctgtccagagcaaacattttaaaatattggtcctattctgtcttataacagtctgctctggtgatttttgtctcatcaattggattatgacactgtcagccactgttagtgttattctcaaattcagtcttccattcatctctccttcccttccctggcagacagacttctgcagccactgggactgttggggtgaggaaaggcaagaaccgatgtttcattctctccctcccttcttcctccctcttttttgttggttgtggggtgggctacatcttcttacccaaacaaccaggagcatttgttggcaagtttattgtgcccagtgccgatgtctggacaattaattccctaggtcagtggctttcacagtttgtgatggtgactccaggaaggaaactcaccatgaccctgtatatacatagaacaaaaatgcagcccactctgatattgtatttgttctattctagttcattaaaagtgaatgttggtcttcatccttt

SEQ ID NO: 127414 - DNA, 2525 bp, Homo sapiens
  Payload ID: 4935
  Gene Symbol: DISC1
  Gene Name: disrupted in schizophrenia 1
  ENST ID: ENST00000366632
  CDS Start-End: 54-1202
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaa

SEQ ID NO: 127415 - DNA, 2676 bp, Homo sapiens
  Payload ID: 4935
  Gene Symbol: DISC1
  Gene Name: disrupted in schizophrenia 1
  Uniprot ID: Q9NRI5
  ENST ID: ENST00000366633
  CDS Start-End: 54-2321
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaa

SEQ ID NO: 127416 - DNA, 2224 bp, Homo sapiens
  Payload ID: 4935
  Gene Symbol: DISC1
  Gene Name: disrupted in schizophrenia 1
  Uniprot ID: Q9NRI5
  ENST ID: ENST00000366636
  CDS Start-End: 54-2090
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggatataagtactgtgatgcagagtcctggacacagagaagtcagcaacttgcctgaggacagcctgcaggacacagcactgtgatttgaacccagagagtctgacttcagcccccagcgctcaactactattaattgaaagggcattgaagagacatgatgtcacaataaaaagaaaaaaagaaaagaaa

SEQ ID NO: 127417 - DNA, 6848 bp, Homo sapiens
  Payload ID: 4935
  Gene Symbol: DISC1
  Gene Name: disrupted in schizophrenia 1
  ENST ID: ENST00000366637
  CDS Start-End: 54-2552
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggaatcttacatcctttctgcagaacttggagaaaagtgtgaagacataggcaagaagctattgtacttggaagatcaacttcacacagcaatccacagtcatgatgaagatctcattcattctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggca

SEQ ID NO: 127418 - DNA, 7059 bp, Homo sapiens
  Payload ID: 4935
  Gene Symbol: DISC1
  Gene Name: disrupted in schizophrenia 1
  ENST ID: ENST00000439617
  CDS Start-End: 54-2618
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcattctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaa

SEQ ID NO: 127419 - DNA, 2939 bp, Homo sapiens
  Payload ID: 4935
  Gene Symbol: DISC1
  Gene Name: disrupted in schizophrenia 1
  ENST ID: ENST00000422590
  CDS Start-End: 32-166
ggcggagcgggaggagctggcagcggggcgcatgccaggcgggggtcctcagggcgccccagccgccgccggcggcggcggcgtgagccaccgcgcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaacttttggcatatttagttccattttcattctaatttagtggctagaattagaatatgcagtctaatatagaattaccatatatagcatacattatatatgtcatatataatatagttattatattcactatagattatatatgccatacatgatatttaacatatatactatacattatgtattgtatgtcatatatgatgtttatatatttagaatctatatattacaatatattattatttatttgaatgaaacattcaaatatatgtatttatcccattaattgtttttaccaaaaccagatcataatgaatgtttataatgttcttctttcataaacacaactaaagtttggcctgagatatatgtattacaaattaaaatatggttttatttaa

SEQ ID NO: 127420 - DNA, 2349 bp, Homo sapiens
  Payload ID: 4935
  Gene Symbol: DISC1
  Gene Name: disrupted in schizophrenia 1
  ENST ID: ENST00000537876
  CDS Start-End: 54-1922
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaggacatggcacgctgtggcatattctgcctgatgtctctggaggcatagttggtgcccatcccactttttattaactctcttggttgaaaacacagcccagaagacatgttgggacttcataagcacagcctaaggaggaacattggaaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggatataagtactgtgatgcagagtcctggacacagagaagtcagcaacttgcctgaggacagcctgcaggacacagcactgtgatttgaacccagagagtctgacttcagcccccagcgctcaactactattaattgaaagggcattgaagagacatgatgtc

SEQ ID NO: 127421 - DNA, 2658 bp, Homo sapiens
  Payload ID: 4935
  Gene Symbol: DISC1
  Gene Name: disrupted in schizophrenia 1
  Uniprot ID: Q9NRI5
  ENST ID: ENST00000539444
  CDS Start-End: 54-1793
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 127422 - DNA, 2940 bp, Homo sapiens
  Payload ID: 4935
  Gene Symbol: DISC1
  Gene Name: disrupted in schizophrenia 1
  ENST ID: ENST00000535944
  CDS Start-End: 54-1883
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagggaggtgaggcatcagactgctccctgccgtaaccatcaactagagaaacccgtcatcaatatttgggctttccatttgagaaggaagatatgtcttttccaagctgatgggctgcagcatggatctgcagaagtgaagcatttgaaagaaaccagtgtagaaccagctggctcaacagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 127423 - DNA, 2505 bp, Homo sapiens
  Payload ID: 4935
  Gene Symbol: DISC1
  Gene Name: disrupted in schizophrenia 1
  Uniprot ID: Q9NRI5
  ENST ID: ENST00000535983
  CDS Start-End: 54-2141
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggtctgtccttttcacatggcctccagaggggacccttattctaaggggtgctttgggaccatgctccaaatgggaacaataaatattgggaaggcttcccattgagcatataaacttttaaaagtttcaataactcttgaatatgattacaaaataaagtagaatttttgtagaagtttgaaatatagaagagcaaaaaaacccaa

SEQ ID NO: 127424 - DNA, 2606 bp, Homo sapiens
  Payload ID: 4935
  Gene Symbol: DISC1
  Gene Name: disrupted in schizophrenia 1
  Uniprot ID: Q9NRI5
  ENST ID: ENST00000602713
  CDS Start-End: 54-1124
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaa

SEQ ID NO: 127425 - DNA, 1553 bp, Homo sapiens
  Payload ID: 4935
  Gene Symbol: DISC1
  Gene Name: disrupted in schizophrenia 1
  Uniprot ID: Q9NRI5
  ENST ID: ENST00000602873
  CDS Start-End: 54-659
ggaaggagcaggaggcagcccaggcggagcgggaggagctggcagcggggcgcatgccaggcgggggtcctcagggcgccccagccgccgccggcggcggcggcgtgagccaccgcgcagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 127426 - DNA, 2533 bp, Homo sapiens
  Payload ID: 4935
  Gene Symbol: DISC1
  Gene Name: disrupted in schizophrenia 1
  Uniprot ID: Q9NRI5
  ENST ID: ENST00000602700
  CDS Start-End: 54-1124
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 127427 - DNA, 2761 bp, Homo sapiens
  Payload ID: 4935
  Gene Symbol: DISC1
  Gene Name: disrupted in schizophrenia 1
  Uniprot ID: Q9NRI5
  ENST ID: ENST00000602281
  CDS Start-End: 54-2042
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 127428 - DNA, 2691 bp, Homo sapiens
  Payload ID: 4935
  Gene Symbol: DISC1
  Gene Name: disrupted in schizophrenia 1
  Uniprot ID: Q9NRI5
  ENST ID: ENST00000602822
  CDS Start-End: 54-1124
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagcagtctctcccttggcaaggtcttgagcattttctttgtgtgacaattatcttccttttgtcccttggctccgtctccttgtctgcacaatcatagactaaatcaggctgatctgagaaaattgagggaagaccataaagtggctcttctatgtgtggacttttctgagagcttctttccccaggaaggatgatgtagaagatgtgaatgccgccttagccaaagtgtctgcttgtcagaggagttcaagtgttcctgtgttctttccttttccagtcgttaggagtaactgagcttactctgagatttgcacccagagggatggtctcagaagacgctggttcagtgcaaattgagatggtaaaaacttatttcttaaaaaatggttcctaaataaatgtcatttactaaaacaaatgaaagaaatatatatatgaataaatggctatatttt

SEQ ID NO: 127429 - DNA, 6927 bp, Homo sapiens
  Payload ID: 4935
  Gene Symbol: DISC1
  Gene Name: disrupted in schizophrenia 1
  ENST ID: ENST00000622252
  CDS Start-End: 54-1382
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttag

SEQ ID NO: 127430 - DNA, 6689 bp, Homo sapiens
  Payload ID: 4935
  Gene Symbol: DISC1
  Gene Name: disrupted in schizophrenia 1
  ENST ID: ENST00000620189
  CDS Start-End: 54-2252
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcacctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcattctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgcttt

SEQ ID NO: 127431 - DNA, 2363 bp, Homo sapiens
  Payload ID: 4935
  Gene Symbol: DISC1
  Gene Name: disrupted in schizophrenia 1
  Uniprot ID: Q9NRI5
  ENST ID: ENST00000628350
  CDS Start-End: 54-1733
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagaaacaagtgtgaaggaaaatactatgaagtacatggaaacacttaagaataaactgtgcaggtaaggataataatttctgtatttcagactccgtagcacatctagattctttattataacagaatttagttaaatcgatgaaaaaggctggccagtttctctaataaattaacaaagaaagacacaaaaaagccttttgaaccccatcagtgaaagagcaggtgccagccctcatcttgtcttttaaaaagtaagtagattaagatgtttaaaagtgtcttggagagatcacaggagagttttcatgttccataagagaagaatcttctttactatattaaattcagaattcattccttagtctgtttttcccttttttaaactttagtgtttgaggggggtcttaaggattttaaggcggtttatacatggtttggaataatatagaaatgcacgtcttaggttctgttttgaatcctgaatcaaaaccagcatgaaaatttctggttgctttttttaaaacccaattaggaattcatctttgagaaatgtcagggatgctgcagcatgacaagatgtttctggcttttgtggatgtgtgcttaggaaaataaatcccagtcatcagaatctgttcctaattaaggcaacaagtactagagtggaatatgcgct

SEQ ID NO: 127432 - DNA, 2130 bp, Homo sapiens
  Payload ID: 4936
  Gene Symbol: DLX1
  Gene Name: distal-less homeobox 1
  Uniprot ID: P56177
  ENST ID: ENST00000341900
  CDS Start-End: 143-532
gacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagagggaagaaggaacagtggaggcgggacgccctccatctcctcggagccccgcgaggtccggcccagcaacttcccggcatccgcgctctagcctgaaccctggcctgggccgagcagtggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcggcctcagcaaaaagccacaaggtctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaattccagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttgaaagaa

SEQ ID NO: 127433 - DNA, 2640 bp, Homo sapiens
  Payload ID: 4936
  Gene Symbol: DLX1
  Gene Name: distal-less homeobox 1
  Uniprot ID: P56177
  ENST ID: ENST00000361725
  CDS Start-End: 453-1220
gggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacccagagggaagaaggaacagtggaggcgggacgccctccatctcctcggagccccgcgaggtccggcccagcaacttcccggcatccgcgctctagcctgaaccctggcctgggccgagcagtggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcggcctcagcaaaaagccacaaggtctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaattccagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttgaaagaa

SEQ ID NO: 127434 - DNA, 1022 bp, Homo sapiens
  Payload ID: 4936
  Gene Symbol: DLX1
  Gene Name: distal-less homeobox 1
  ENST ID: ENST00000361609
  CDS Start-End: 509-1022
gggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgaaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcagg

SEQ ID NO: 127435 - DNA, 762 bp, Homo sapiens
  Payload ID: 4936
  Gene Symbol: DLX1
  Gene Name: distal-less homeobox 1
  ENST ID: ENST00000469444
  CDS Start-End: 201-762
agcgcgggttcctggctctccacgcgcactgctttaatcagacccgtgcagcctcgagctggagtggccagctgggcctggagcaatgcgagcgggccccagggagcgacagcggcgttggcgcagcggccgaaaacatagagacccccaaaagggaagcagaggagagaaagtcccacacccagaccccgcgagaagagatgaccatgaccaccatgccagaaagtctcaacagccccgtgtcgggcaaggcggtgtttatggagtttgggccgcccaaccagcaaatgtctccttctcccatgtcccacgggcactactccatgcactgtttacactcggcgggccattcgcagcccgacggcgcctacagctcagcctcgtccttctcccgaccgctgggctacccctacgtcaactcggtcagcagccacgcatccagcccctacatcagttcggtgcagtcctacccgggcagcgccagcctcgcccagagccgcctggaggacccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtcaagatctggttccaaaacaagcgatccaagttcaagaagctgatga

SEQ ID NO: 127436 - DNA, 2453 bp, Homo sapiens
  Payload ID: 4937
  Gene Symbol: DLX2
  Gene Name: distal-less homeobox 2
  Uniprot ID: Q07687
  ENST ID: ENST00000234198
  CDS Start-End: 363-1349
agacaatcgtaaagccgctcggggccgctcacctgctcccgcctcccagagccccgacccggcccagccacccctgccccctccactgcccgccccccgccagagcccgcgctcgcgctgggcaaggagccgagcgggcccagaggccgaaagaggatgcgaccagaggcagctgtcccgagcagcgcacggtgatcgcctcccccggaggaggaggcgcctagacggttgcctcctttcttgtttccccaccaccacccccgtaattacattggctgctggaggggaccgggagagacagaggaggcgcctggcttcccccgcacgcccgccacctctgctctttcccgtctcgggccaggatgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcggggacgattttctaaccccagggagaactcgccagagactgagagcagagaccacttatcctcattgcttaccccgagccggggttccctcctcccggcccgctgccgccacccacctctcctgcaggctgcgacctgcagtggcccgtctcaggccctgctcactcccggggccaccaaacgggcccctctctcgggggaaccggacagcagcttggcaaaggcctccctaaaaggccgcatttctgacctgagccccgggtctcggctgtttcgagccccgcctcggacttgccttccctcccctccgggtgagcctgtctggcgccttcctcgccccgggctgagagctgggtcccgggagatggaagcctcccaggcgcgcgaggcttcccgggcgctctgaggcttctttctcctcgcccgctcccctgggctcagctcggacgctgcagttattgacctcccggtcccgcctgcccgccctcccccacgtggccccttgacccgggcggccccgccgcttctttccttcctgcagttcccagccctcggagcccccatcccttatcttacccccaccgcgctcccccaggagcgctccctcagctctctcctcatccatcaccagtggagtttttttatttgttatttttttaaaagtttaggtgcctttgcggatgacctcattttgacgttgaaaaaatgattttttaatatgtgaacactgcaaaaatgtgtttaaattatcttttttaaaacctattcaggattattagcctggacttggacacagagtttgtaaataaaggtgtctgtgcagattttcccactgatttatttgtataaaaatactcatcttttcagacttttttgtaaacccccagttgtgaaaactgcagtttagcagtgacctcagcaacccctcctttttattttttcctttaaaaacatttcagttaaattaagctactgatttggatttgttttatcgtatcctaaagtctttgttgttgaaatgaaaggtattttggggttatttattatgaaaacaacatgctcttaatgttgattttacaatatgaagagattatttaaataaattattgttttcattgg

SEQ ID NO: 127437 - DNA, 1852 bp, Homo sapiens
  Payload ID: 4937
  Gene Symbol: DLX2
  Gene Name: distal-less homeobox 2
  Uniprot ID: Q07687
  ENST ID: ENST00000466293
  CDS Start-End: 363-1016
agacaatcgtaaagccgctcggggccgctcacctgctcccgcctcccagagccccgacccggcccagccacccctgccccctccactgcccgccccccgccagagcccgcgctcgcgctgggcaaggagccgagcgggcccagaggccgaaagaggatgcgaccagaggcagctgtcccgagcagcgcacggtgatcgcctcccccggaggaggaggcgcctagacggttgcctcctttcttgtttccccaccaccacccccgtaattacattggctgctggaggggaccgggagagacagaggaggcgcctggcttcccccgcacgcccgccacctctgctctttcccgtctcgggccaggatgactggagtctttgacagtctagtggctgatatgcactcgacccagatcgccgcctccagcacgtaccaccagcaccagcagcccccgagcggcggcggcgccggcccgggtggcaacagcagcagcagcagcagcctccacaagccccaggagtcgcccacccttccggtgtccaccgccaccgacagcagctactacaccaaccagcagcacccggcgggcggcggcggcggcgggggctcgccctacgcgcacatgggttcctaccagtaccaagccagcggcctcaacaacgtcccttactccgccaagagcagctatgacctgggctacaccgccgcctacacctcctacgctccctatggaaccagttcgtccccagccaacaacgagcctgagaaggaggaccttgagcctgaaattcggatagtgaacgggaagccaaagaaagtccggaaaccccgcaccatctactccagtttccagctggcggctcttcagcggcgtttccaaaagactcaatacttggccttgccggagcgagccgagctggcggcctctctgggcctcacccagactcaggtggggctcgcgccctgcaggggcgaggagagcgcgggcctgagatggctgggaagcaggcgggtttaggacaatgctttttaaagttcattttaagtacttttaaggatttccaggcctgcgcctcgagcggccctaagtaagcttctaggcccaaagctggaaacccccaaggggccgccgtgggagggaaggaaagggaccgggtggacagaaatcccgtacctctcgctactgattaagcgggtgaaataactggccctcctcaccctcccgctgtcaccatcatcacagtgcacgtacaccagcagtcctggccttttggcaattacctccccagggagcaggaaccggcagagcctcgaaggccgccgcccgtgatcctcttatctccccagggcgctcgctgcccaccgctagccagcggtttttctctgccttcttttttctcctcttcgaacccctactgccccaagactaggttcctccactaatgctcaggtctttttcctcaaaggtcaaaatctggttccagaaccgccggtccaagttcaagaagatgtggaaaagtggtgagatcccctcggagcagcaccctggggccagcgcttctccaccttgtgcttcgccgccagtctcagcgccggcctcctgggactttggtgtgccgcagcggatggcgggcggcggtggtccgggcagtggcggcagcggcgccggcagctcgggctccagcccgagcagcgcggcctcggcttttctgggcaactacccctggtaccaccagacctcgggatccgcctcacacctgcaggccacggcgccgctgctgcaccccactcagaccccgcagccgcatcaccaccaccaccatcacggcggcgggggcgccccggtgagcgcgg

SEQ ID NO: 127438 - DNA, 2602 bp, Homo sapiens
  Payload ID: 4938
  Gene Symbol: DLX3
  Gene Name: distal-less homeobox 3
  Uniprot ID: O60479
  ENST ID: ENST00000434704
  CDS Start-End: 227-1090
agcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacaattgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacataccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcccagccttctcatttctgctttcttactggactcatctttatatataatgttaataaaaaagacgaaaataa

SEQ ID NO: 127439 - DNA, 834 bp, Homo sapiens
  Payload ID: 4938
  Gene Symbol: DLX3
  Gene Name: distal-less homeobox 3
  ENST ID: ENST00000512495
  CDS Start-End: 149-652
cgcggcgagtcggtgggcggaagcgaggggcgtccggcggggccctggagggtcgcaggagtcgcaggccgaggctgaaccgccccctcttccgcccggtgcgttccccgcagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacaattgcatggaccaaggatgccc

SEQ ID NO: 127440 - DNA, 2034 bp, Homo sapiens
  Payload ID: 4939
  Gene Symbol: DLX4
  Gene Name: distal-less homeobox 4
  Uniprot ID: Q92988
  ENST ID: ENST00000240306
  CDS Start-End: 296-1018
agagggcggggcccccgtcgggtcccgggaaccgaacccgatggagaggagggggcccccatggatttagggggggaggggaaagtcatggggggcacccccccggaacccctttcccaggcgcgcgttctccgctgaaagaggctcagagagacactttctccgggatcttaagtgtgggggctgctggctggggggcccgtccggcccaacgccggaggcttggaaaagagagttggcagcgggagcggactacgtgccgggccatggcccttctgcccgggccctggccacaatgacctctttgccctgccccctccccggccgggacgcctccaaagctgtcttcccagacctcgcccctgtcccgtcggtagcggctgcctacccgcttggcttgtcccctacaaccgcagcctcccccaatttgtcctactccaggccgtatggccacctcctgtcttacccctacaccgagccagcgaaccccggagactcctacctgtcctgccagcaacccgcggcgctctctcagcccctctgcggacctgcagagcaccctcaggaactcgaggcagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaagccctctttcccaccccctccccatctcccctttttgaatagataatggatccaattatccatataattcaataggtatttattgagaggctcccttctattccccatccctaatccctaacgaacccacgggcacacacttttggaaacctggtaaagtaacacttagggggaaatggggacaaactggctctctggattagtgcgggtatagacacccccaaataggtgggtaggcccattgattcagctccttgcagctgtctctgttcaaaggaactgtgcagatttagaacgaattggagcttgagcttcacaccaccagcttccagagattaaagtttgtacaaaacattgca

SEQ ID NO: 127441 - DNA, 1404 bp, Homo sapiens
  Payload ID: 4939
  Gene Symbol: DLX4
  Gene Name: distal-less homeobox 4
  Uniprot ID: Q92988
  ENST ID: ENST00000411890
  CDS Start-End: 241-747
ccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaa

SEQ ID NO: 127442 - DNA, 1662 bp, Homo sapiens
  Payload ID: 4939
  Gene Symbol: DLX4
  Gene Name: distal-less homeobox 4
  Uniprot ID: Q92988
  ENST ID: ENST00000611342
  CDS Start-End: 68-412
cgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtggggccagtgtcgtccttccccatctctcaccttccctggttctctgggaactcatcccccagccccagctgtgaatgactgatggattggtgctgtggccctgttgtcacagttctccagggaatgttcatagctggctcttagtaagccttggggggaatgtgttgaaaggtgtgcatgtatgtgcgggtggggtggagtgggtcaggaagaggagggtaggtcagacagggagacatggatactagctcagaggcaggaactcagaaggctcctggggctgtgggggactgaagcaaatgttcccagcctagggaactgctggtctcccaggactgtgcctgcacctggatccctttcccttcctcgaaacttttcacacatatcttcctcctgatctttcattctttccccttttcttcccgaaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaa

SEQ ID NO: 127443 - DNA, 1688 bp, Homo sapiens
  Payload ID: 4940
  Gene Symbol: DLX5
  Gene Name: distal-less homeobox 5
  Uniprot ID: P56178
  ENST ID: ENST00000222598
  CDS Start-End: 475-1344
actaaaaacagatagactaagacccctccccactccacaacaagcaaaaacacacacaagcgcgcgggcgcgcacacacacaaacacacacaccccctcagtaccccccaccccctttttaagcaatgctttgttgtgctaaaactagttggacgagttagggtgttactgttgctcccgaggccctggccaatagaaccagatccaccccgctgtgcgtaagcgcgcaattaaggatttaaccaaggctgtgctgcgcctcagccagcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaagcgg

SEQ ID NO: 127444 - DNA, 1074 bp, Homo sapiens
  Payload ID: 4940
  Gene Symbol: DLX5
  Gene Name: distal-less homeobox 5
  Uniprot ID: P56178
  ENST ID: ENST00000486603
  CDS Start-End: 328-903
gttggacgagttagggtgttactgttgctcccgaggccctggccaatagaaccagatccaccccgctgtgcgtaagcgcgcaattaaggatttaaccaaggctgtgctgcgcctcagccagcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtaaatacggcgctgccatgcactagacctgcctgagctgcacgtctggttgggtcgcgcggttcagtctcgatgggactggagctgttttgacagtacccgtgagaaactaacagacccaaagacatcagcccctatgctttaactcggtgagtcaggccttgagacggtggggatggtattcatcagcggtctggagatacctcc

SEQ ID NO: 127445 - DNA, 2304 bp, Homo sapiens
  Payload ID: 4941
  Gene Symbol: DLX6
  Gene Name: distal-less homeobox 6
  Uniprot ID: P56179
  ENST ID: ENST00000518156
  CDS Start-End: 431-1312
aaaccattcgactcgtggcgtctgcatcaagtctgaaagcagacgcgcaactttcgcagaatccaccttaaaatctctgccttaaactgcaccagcccccaaaaaatccaaggggggaaagcaggcggggggagagcagattcccccctccccctctcctctcccatccctcctccttcctcctccctttgagttaacaaggccccgctcactatatctctttatattaaatatatatatatattagagaagagcgagggagagggagaaccacctccacccccctctttaaattcttttttttttttttttttttttttgcaaggatccaaagagctaaggtggctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagccgcactcgcagcagagctccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctctctctctctctccctctcctttctttttacttcttcctttcctccattccttctttctttccttttcctttctacctttcttttctttttgcctttcaccttttttctcatttaccttctctcttgagcaacgtcagtaattgatcttgcatctcagagagagagaaagagcatgtgtgagagagaaactggtttctatgccagcactcctgaaaccccttactgtaaggatattttctcttaccccttgggatccaggctctgagtctcttctctttgggagtatccatcaaaatgactttttttaaaaacagattttcccccaaccagaagaatctgcacaaacttggcagcgtttttacttgtttaatgagtttaagacattacatggtgaaagagaagcattttggactcctgcatttttatttaccattcccagactgacgagaaaaagaaaattcctcacataacagcccttctctaaagaaaaaggaaaaagtggctgtaagattagaacattgctacaaagggaatgctgcatgttttatcaaaatgcaatgaccaggaatgatggttgattaaaaaaaaacaaaacaaaaaccactctttccccaccccacccccccaaaccctgaactggaatcaggaaagacggaggaaacaatcaaaatcaccattctattgctttgacacctttactaggtgaattggtggcattcacaaagctaatagggacgtttatatcaagaaacatttctgtatatattgttgaattttagttgtacatatactttgtatgtttttgtcttctttcatatatggagtaaaagccacaaaacgctg

SEQ ID NO: 127446 - DNA, 666 bp, Homo sapiens
  Payload ID: 4941
  Gene Symbol: DLX6
  Gene Name: distal-less homeobox 6
  ENST ID: ENST00000555308
  CDS Start-End: 162-659
cacattgttcgggccagggactgggtcaaggagattacgcagacgctgggagcacacgggcagagtggaccaagagaggtcggggcatcatagggatttttcgaggtaacccttattgggctttggggagactcgttgcatgccacgccaggagcagggagatggcagcagtagcctcccgggtgaccgctcctctgtattatttgcttacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgccc

SEQ ID NO: 127447 - DNA, 648 bp, Homo sapiens
  Payload ID: 4942
  Gene Symbol: DPRX
  Gene Name: divergent-paired related homeobox
  Uniprot ID: A6NFQ7
  ENST ID: ENST00000376650
  CDS Start-End: 52-627
tgctagttcttatccctggacctgaacccaggcgcacatctggattagaagatgccaggctcagaggatcttcgtaaaggcaaggaccagatgcattcacacaggaaacgaaccatgttcactaagaagcaactggaagatctgaacatcttgttcaatgagaacccatacccaaaccccagccttcagaaagaaatggcctcgaaaatagacatacacccaacagtactgcaggtctggttcaagaatcacagagcaaaactcaagaaagcgaaatgcaagcatattcatcaaaaacaagaaactccacaaccgccaataccagagggtggggtctccaccagtgtcggcctgagaaatgcagacacactacccagattgcccaacgctgctcacccgatcggcctggtgtacacgggtcatcgagtcccctcattccagctcatcctgtaccccaacctcaaggtccctgcaaatgacttcattggccacagaatagtccattttggctgctgccgagatcctaatatatactgcctctaccccattttggaatcccaagtttgcgctccaagcttccattctggctctcctgcctgttcatctaaccaaagtcgagagagatgataaatacaaaaagtcacatgt

SEQ ID NO: 127448 - DNA, 5897 bp, Homo sapiens
  Payload ID: 4943
  Gene Symbol: DIXDC1
  Gene Name: DIX domain containing 1
  Uniprot ID: Q155Q3
  ENST ID: ENST00000440460
  CDS Start-End: 298-2349
tcccgcaggaaagcggggctgggggcagcccggcagcgccgctcaacctagtgcgcgcccagttgtttccataggaaccgcgaccgcgccgggcccctccagcggaggcccccgtgcgagcatgcccagtgcaagccgctagtttggctccagtctaggtttccagtaagtggcatgcgggactccggagggatcccaatgagctgagccgagagcctttgtgtgcagagggaggaggaggaggcggcggcggccgccgggctggagaccccgcccggggagcccccagcaggaacaatgctagcctgcctgacccgagggaacttactggacgtcctgcaggagggcttcaatgagcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaatttttacatttttaaatttgaagaatttgttttaaacttacttggtaatggcacttctacttactgaccaacttttcagctctttttgaccaggatggttgcaaattagggaaaatatctttatactatacatccaattcaagaggactttaattacttaaaagcatttaggtcataattaaaattattttcactgtttccataaaataagcattatgattgcacactccttctactgtctgaatttatgtaagaggtatagcttgcttaaaatacatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaactaaa

SEQ ID NO: 127449 - DNA, 1945 bp, Homo sapiens
  Payload ID: 4943
  Gene Symbol: DIXDC1
  Gene Name: DIX domain containing 1
  Uniprot ID: Q155Q3
  ENST ID: ENST00000529225
  CDS Start-End: 281-937
gttgggggggatctgggtccagggggcgcggtctgggcctgcaggaggcgggatccggcgggccagaggcgggaccaaggccggcaggggctggctctggctggctggagtcgggcggggcttgtggccggcccccgcatcaccatggcagcgggaaaccgcggcaaagccagagcactggcaggccgagctcaggagggctggggacagagatgctgaaccagacggacccatcatttaagagatggccctgattcgtctcttctagggactcttgaagatggggacccaagtggttatgagattcaataactccttgctgccaacagagccttctcaacagctgcaggcctatgtggcctgggtgaatgcacagctgaagaagaggccagcagtgaagcctgtgcaggacctgcgacaagatctccgggatggggtgatcctggcatatctcatcgagattgttgcaggagaaaagctgagtggggtacagctgagtcccggtaaccaacaggagatgaagaataatgtggagaaagtgctacagtttgtggcctctaaaaagattcgtatgcaccagacttcggctaaagatattgtggatggaaacctgaagtctatcatgaggctggtccttgccttggcagctcatttcaaacctggctccagcaggacggtgaaccaaggacgggactccagagcccctctgcaaagtcaccgaccacactgtgccactgctgttgcccagggagcagctgctgctctggccgatgtgtgtcatgacatgtcccgatcaggacgggatgtctttcgatatagacagaggaacagcagcatggatgaggaaattgagaatccatactggagtgtgcgggccctagtgcagcagtacgaagggcaacaaaggtccccgtctgaatccagctgctccaggtaactgtggcctctgaaacctgaattctggaggattctcggagttctcggcttcaagtaacaatacaacaagcaaaaaggcacctaagccctttttctcccctcagtttatgtttggctttaaagggataccccttagcagtgctttgtgggtttgtgctagtaggagggtaggaaggtagggtggggtgctggtttatttcccacaaatggaatctgtgcagtcccagtgccagtgcttaactgtgaccacatgggggcatggctggaacctgtcagggcccagtccagtggttctgacatttgcatatgaggtgccagtgtttatgatagccagttccattgtgctgtccttgagcctaagtgtaactcttaaggccggaaaagtctgtgtaaagctcatagaagagaagaaattgagcagagttgtcttagagcattagaatgtttccaactttcctctacaggaactgtggctgattagtatgtgtttgagcaaactaatgatgtttgcgactctagctaaaagttgtgtgtatcctttagagccaagtacagagaccaaaacaggatacagtgccctaataaaaaccttatcagtggcagaaaaaagattactttactggctcatgtaaattgtgcttctataaacactccccagatcatgtttttactaacttcattttgttgctgaatcataatttatgctctaatgaccttttctttcctatcccaaccctgtgtaatctgctctatttagggctaattgttccttgtcttgtatgtatgttatgtgtccttgttttcttcctcctatttttttctcataaaactccatcctattttaatgcacatttcctaatttattgaggtcatatggaactctttctagtattttaatatactggtaaacttgctaactttttaccttttttacatttaatagctgtgctctttcttacttataaaattcacataacataaaattaaccattaaacattataaagtgta

SEQ ID NO: 127450 - DNA, 559 bp, Homo sapiens
  Payload ID: 4943
  Gene Symbol: DIXDC1
  Gene Name: DIX domain containing 1
  ENST ID: ENST00000614104
  CDS Start-End: 329-559
gagcgtcagagtctccaccccgaggagcggccagagccccatgcgggcctgacctgtccgaccgacccctcgtccaccaagggagggctcagagtggagaagcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaag

SEQ ID NO: 127451 - DNA, 4825 bp, Homo sapiens
  Payload ID: 4943
  Gene Symbol: DIXDC1
  Gene Name: DIX domain containing 1
  Uniprot ID: Q155Q3
  ENST ID: ENST00000615255
  CDS Start-End: 464-1882
atccggaaggtggcacggagtgggatcgccgctggggactcgaggcgcagcctgcgccgccgggagcctccctcccagtgggagatgggttgagatgcccccgccaggggggatgcccggcaccgtgcgtccgcggaggccaagatgcagcggccaggggccggcagcctgcgaggggaggcagcttccgccggggccgggctgctgcacagtctgagcggccgggactgcgcgcttcagagcctggagcatcccagtcgctggggccgagacgccgccgccgccgccgttcccgctttctcccgcgagccgggccagtagctttgctagctggccttcccgtggaggcgttttccagccccagcgcggggagacatgcctgaatttgggagcgatgtgactctcagcctcccacttcacccggggacgcaggcttgctgaagcccgagacaggagggggaccatgggagggacgcaagtcaaatgcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctcc

SEQ ID NO: 127452 - DNA, 7447 bp, Homo sapiens
  Payload ID: 4944
  Gene Symbol: DLC1
  Gene Name: DLC1 Rho GTPase activating protein
  Uniprot ID: Q96QB1
  ENST ID: ENST00000276297
  CDS Start-End: 411-4997
gggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaa

SEQ ID NO: 127453 - DNA, 1837 bp, Homo sapiens
  Payload ID: 4944
  Gene Symbol: DLC1
  Gene Name: DLC1 Rho GTPase activating protein
  Uniprot ID: Q96QB1
  ENST ID: ENST00000316609
  CDS Start-End: 290-1786
ttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgcggtaaaatcagtaaagttggaagtggatgaagataagagcacaaagggatccaatttttccaactcggaagtggcaattggtttgtctccttacacctttccccagaagaggcttttccatgttgctggagaagaaaacatcacctaggccggtgtgtgcctggcagaacactgcactccaatttcctcgggcagccac

SEQ ID NO: 127454 - DNA, 4392 bp, Homo sapiens
  Payload ID: 4944
  Gene Symbol: DLC1
  Gene Name: DLC1 Rho GTPase activating protein
  Uniprot ID: Q96QB1
  ENST ID: ENST00000358919
  CDS Start-End: 495-3770
gaggctgcggccacgaggaagaggggcggggggcggagcctgggaatggggcggggccggagaacagcccgtcgctaaggcctgcgacccagacagcggggaggaggcggtgccgcccgctctggccccgcccctcggggggtgggcccagcgggagggcccggctggcggagcgcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacaccctt

SEQ ID NO: 127455 - DNA, 3758 bp, Homo sapiens
  Payload ID: 4944
  Gene Symbol: DLC1
  Gene Name: DLC1 Rho GTPase activating protein
  Uniprot ID: Q96QB1
  ENST ID: ENST00000512044
  CDS Start-End: 147-3524
agttggcgcttcccggggccgcagtgccagccgcaatgccggcctcctgaaggcaggcgacagcctgcggccgggagcacagcgcggggcggagtaccgaggcatggtcgcggcgcccgggctgcgctgaaggcgtctgcgagcggatgggggaccccaaggcccacgtgatggcgcgccccctgcgagcccctctccggaggtcctttagcgatcacatcagggactccacggccagagccctggatgtcatttggaaaaacactagagacagacggctggcagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaa

SEQ ID NO: 127456 - DNA, 2451 bp, Homo sapiens
  Payload ID: 4944
  Gene Symbol: DLC1
  Gene Name: DLC1 Rho GTPase activating protein
  Uniprot ID: Q96QB1
  ENST ID: ENST00000511869
  CDS Start-End: 412-1803
tgggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctggtaagttgacattttggttctgttttctcgccaatctattttagaataaatttcaccttaaaataggcattttattaaatatataaaatgtatacatctcatgaatatatgggaaaatgttgtttaaattctgtaaaagaaatttgttttgctcaatatgtaagaaaaatatacgtggttttctgacataatgacattgtgttagaataagatatgtgtttcttggggtcttccttgtaactgcaaccacaatttttttttcttaagcaaaagaattaaatgttgatcaaggttctggggaatgaatttggaaattagttattaataattaccaaggtttatttttactcttaatgacttagtagccacagaaaaagatgtaattgatgcttaaagctgatgccatactatcaaaaatatagtgatgaagcaatgtgaataattgtattgaagaaaaaaattatagtatttttctgtgttctgtgctttaattataattatttaacagtattatgggaaatggacaaggactgatgagaaatgaaaatatgaaaaattagacatggattggtagatctatgtgtttttaaaaaatcatactatcttatgtgttctgtgtaataaaaacgaaaacagattaaaggtatattatctaacttgaagtacatcacttagtttgtagacatttgtga

SEQ ID NO: 127457 - DNA, 3556 bp, Homo sapiens
  Payload ID: 4944
  Gene Symbol: DLC1
  Gene Name: DLC1 Rho GTPase activating protein
  Uniprot ID: Q96QB1
  ENST ID: ENST00000520226
  CDS Start-End: 285-3338
actgacttcgtgccctccatgttccttgacagcctgggcctctcctactggattaatacctgatgagtacctgatcacgcaacagtgaaacaacacaagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgc

SEQ ID NO: 127458 - DNA, 562 bp, Homo sapiens
  Payload ID: 4944
  Gene Symbol: DLC1
  Gene Name: DLC1 Rho GTPase activating protein
  ENST ID: ENST00000503161
  CDS Start-End: 417-562
cgttcttgagaatcaaccttgaaagttaaagacaaggccacctgccagccccaccctcccacctcccctgcgtgcttgcctgcggcgctgcgtttccctttgaaaacgcgaggtcacctggactgcccctgaagggaagacctgctatgtgacccaggagcagcccggcgcggacccagaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagc

SEQ ID NO: 127459 - DNA, 383 bp, Homo sapiens
  Payload ID: 4944
  Gene Symbol: DLC1
  Gene Name: DLC1 Rho GTPase activating protein
  ENST ID: ENST00000517868
  CDS Start-End: 1-226
ccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggtaagacatatgcacagattctctggcttttgaaattttgtaaatatccttggatttatcagttatcattttgcttggattaaaaagatatgaagatggttcttttgccctgttatgcagatgtgtaattcaacgactacccacttggtcaaaccatcaaaatatgtaaaaattaaagaataataatcta

SEQ ID NO: 127460 - DNA, 562 bp, Homo sapiens
  Payload ID: 4944
  Gene Symbol: DLC1
  Gene Name: DLC1 Rho GTPase activating protein
  ENST ID: ENST00000631382
  CDS Start-End: 196-562
atcagacaacacattggcagtgagttcatctgctctactctgctttggaataacacatgtgattaaccaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacag

SEQ ID NO: 127461 - DNA, 5569 bp, Homo sapiens
  Payload ID: 4945
  Gene Symbol: DMRTA1
  Gene Name: DMRT-like family A1
  Uniprot ID: Q5VZB9
  ENST ID: ENST00000325870
  CDS Start-End: 226-1740
ctctgccaggctcacgggacagctgcacctctcagcgtctccagctccaggacgcggtcgtcccaactccttccgagtggaaagagtgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgcccagcctctttctgcgagcagcggccgcggccgccgccgccgctgccgccacctcgggaagcggaggctgcccgccggctcccgggctggagagcggggtaggcgcggtgggctgcggctacccgcggacgcccaagtgcgcccgctgtcgtaaccatggtgtggtgtcagcgctcaagggccacaagcgcttctgccgctggcgggactgcgcgtgtgccaagtgcaccctgatcgccgagcgccagcgcgtcatggccgcccaggtggcgctgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcgaagttttccagcaagattatcctgaggaaaaacaagaacaaaaagagagtaaatgtgagtcatgccagaatggacaagaagaactgatctccaaatcccatcagctttacctaggatcatcttctaggtctaatggtgtcattgggaaacaaagtatcgggtcatctatttcagaatactccaacaagcctgatagtatcctgtctcctcatcctggagagcaatcaggaggtgaagagagtcccaggtccttatcatcctctgatctggaatcaggaaatgaaagtgaatgggtcaaagacttgactgcgaccaaggcaagccttccgacagtgtcctcaagaccaagagatcctcttgatatccttactaagattttcccaaattacaggcgcagccggctagaaggcattctacggttctgcaaaggggatgtggtccaagccattgaacaggttttaaatggcaaagaacacaagccagacaacaggaacctagcaaactcagaagaactggaaaacacagcctttcagagagcttcaagttttagtcttgctggaattggttttggaactctaggtaataaatcagctttctctcctcttcaaactacttctgcttcttatggaggtgattcaagtctctacggcgtaaatcctagagtaggtatcagtccattaaggctggcatattcttctgcaggaagagggttatctggttttatgtcaccctacctaacacctgggttagtaccaaccttaccttttcggccagctttggattatgccttttcagggatgattagagattcttcctacctttccagtaaagactcaataacttgtggcagactgtacttcagaccaaatcaggacaatccgtaatgtatatgcccattctctctttctggagtttttccagcatacaatacatgcacgtgcacacacatacacacacatccattaatatacttcagtaagtatgtgagtggattatgaggtcttaaaatgctgggttttttttttttcaagcaatataataggtcttagatctgaaaactcttcattaggatttatcaagtgaaagaagtaaatctgaacattatatgtgccttgaataaagctatttcaggaaatatttaatgaattttctccctaaattatcatttgtaaacatttttattttaaaactagtttttattttattgaaaagtggaatttttagtgataaaatacatttgtaagtgtaaagcaatacagcataatagaatagaatataaaccgaaaggaagaactgaacaattaaggcaattctaaataattaccatttcaaaactgtttcttctattcctggttcataggaaagaaaaaagttattcaaagtatttttaaagcatttgatttgcagatgggtgattcgtaataaataaaacatttgagcattttgaatttatatttcctgagtattttatttttcaatcttagcttccatgagtgaaaacaagtgccattaaaaaacatttctctttaaagttgacactgtgtctatgaagtaaattttaggaaataagactgcgccatctcctggccactatcgccaattgcaactgagctctgtagagtatatgaattagaaacattgattccggagaataaccatttttttttcaaatagtcattttggattatactacattaaaatttccatactgtaaagtgcacatctactgtggatgagagttgcagtctttaagtgtgcttatgtctgtatctggggaaatatccttaaaagtttgggacaagaatatatggcagccattctcaaaggtaagaataattttattcagaaaactaaaatagctgctcaaataaatatttattaactgcagatagttgatgcttaatgcactgaggagagatataagatttccaaaggggaaaaactgccatgaagtttcagaggtattcttgcaattttaaaaataatttttgtcctccctctggcgcatttgaaaactatttatttcagtcagtggaaagtccctgaggaaactgcttacaaaacagtttctaggacattttctttgtatgtcatcatttttcttttttgaaggacagtagcttcattgttattattaggaataaatggaagcccactggtggtaaaagatagttgatgaattagagattgtttaaactatttaagcagcatgactcactaaagattttttaaattatatgtatatacgtatgtgtgtatgcatctatatgcacatatataagtctatgtagacatacattaaacccctataggttatattatcatggaggcgtttttcatgaagccagtaagaatgtatttccaaggaatattttgccagcaaatgtgatattaaattacttcagagtatctgatgctgatttaggatgtaaatgtgtttattaggttatgcattaattttaatggtgtgaatataagaaagcagatcttgaaaaatttcgatgtactcaatattcatttattataaaaaagttttatattctaagcctaaaccgtagtacaatgtctagcaagtagttgaaattcaattcatatatactgagtaagaaactcttatatataatagatctctttgagactctgataaaactgaagaactctacaaaatggcgtacagacacacagttttgcatacaatttcactgggttcttgaatctcctaaatggtattcaggttagattccttggtgattcttcagttgtttctattgcattaatccacttattgaatgctatttttctgaaaagtgctagatcctgtagaggatactgaatgtaaaatattgtgctctaaaggaagttacattatacaatagagatatggtttaaaaaaaaatcctagagttactgcattatgtatgtggttttataatgatgtgcttgtatctgagaaactgaattgcttttgaccttgggagaacatccattttgggcagtattcgaatttataaaatagttttataatcataaaacttaatttatataatgccttacacattccatactctttataataatttaaggacttaatcttatcaaataggtcatttgtctaacaactcagtagtatatgaggaaattggggctcagcagtagggttttttctccctaaggttagtaatatgagtcatctgcagtggaattactgtgctcacttcagcaatttcagactccaatgtctgaggaaggattcatgtctgtttttttcattcatggccttgaacagtgtctgatataggttctcaacctatacactagatttccactgactgaaaaaaaataaaagcaagtattagcttaataatttcttcattcaacacctatttaatatttttaataatctatttgtgccatgcactgtgttagacacaagagataaagaaatgattaagatacaagactttgcctcaagttgctcacggtctatattgtgtgtacaaaaacaaccaatcaaccaatgttggtattatttgacagtgttggtacatcaatgagttctttgtaatcttgatatttatatccatggatgctgcttgaagcctgaactcctaagccactaattagtggtgggaagaaagagggggtaaatgctttaagagctagcatataacaaaaatgaattgggtttattctgtatcatatagagggcctaagaggcaaacatttcatagagtattcagaagaacataaggaatgacttttttcacagttaacagctgtccaagagtgtagtggctgcctcgtatgataaagcatctggaactcattgaaaaatgcatgtagaaaataccaatcagagcctgattgatgggatttttaattactgctttaatattgggactgaatcattttgtagctcattagaaacatggaaagtatttgttaaataaataagtcatggaatttcaattctaaggccatgaaaattaaaacaccctaccattatttatcaataaaacacagtgcagttttgctcatcagaattttgcctatgtgatagcctcctgagagtaggcagaaaagaaagacatagaacgcagtgcgtgacttacaagggaataaaactgacagaggttagtgtaaggtatataggcatgagtggggcttaaagaggatatgggagaacactgaagacaaatattagtacaattcctataaggtaaataccaatatgtctttctagaagaagcaattgttttggaattgaggaaacctagaatggatttatctatatgacttggacaggttacttatactctttggacatttatttcttctcagcaaaacaagggtaataatatttaacttgcaagattcgtggagataaaagcttaaataaacggcagagtacagtaatgcttatatacgggatgctaaataaataactctcactgttattactttgtattaagatattatctttgccccctcgtggcagtctctcaacaaagagtactgtaattgcatttaatccacttagtggatgtggagcccaaagggcagccatcactagagcagcgtacaggcttagttccagacttcgtgtttggttgttcatttcataggcgagccacgtgttttgtaacatattctcgtatatgttatttggattattttcagggctttctgaagaaaataaacatcgaaatcata

SEQ ID NO: 127462 - DNA, 3137 bp, Homo sapiens
  Payload ID: 4946
  Gene Symbol: DMRTA2
  Gene Name: DMRT-like family A2
  Uniprot ID: Q96SC8
  ENST ID: ENST00000404795
  CDS Start-End: 394-2022
tgtccaattctgtctaatggagccctaaggaccaacaatagagcgggcgagcggctcattgagagtctggcagcgccgggcaactgggccccggctgcgcgcagcgtccggcgcgcaccgcgaggggacccggcacggcgagagtcaggtcgcgggttccaaccacgcggcccgcagacgagcctccgacccggatttctgaagggagggttggactgcgctgcgttctgaggggtccggaagttcggacatggtgactgaaggagggtgacgtggtcagataaggggccgggggcaaagggaagcggccaagagctccagcgtcgccagtggagccgggaggcgcgtgcagcgccagcggaggaggaggatcccggagcccaaggtcctgtcatggagctgcgctcggagctgcccagcgtgcccggcgcggcgacggcggcggcggcaacagcgacggggccgcctgtggcgtcggtggcgtcggtggcggcagccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcgggggacctggagcgggagcgcccgcggggaccggaggcggagcagctggcgcagggggctcagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgccgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgtcttctcactctaaggtggtttttgggttttgtttaggagggtgggtggggaaggctgagcaaagggggagcagctacagacaggtgcaggtgttctcggagggggtgcgcggcctgggtcctcatctcctacctccggatccctcttccagcctcacccggccccctttccaaaaggctgggaattcatgagaattcagaggctgcgacagcagcgcaggctcctgcggctccttagctgtgctcatccggctctcagtggatggcaggataatccgagagtcttttctgtgtctccccagccctcacttttaaaaaatttaaatattcgctctaacaaatataaatttaggatgtataaatctcttggcactgagtctttgggacacacatatatatcgatacaattgtaaaaaaaaaaaaaggaaacaagttttaaggtgcactttcctcgttgcggtatttgtcgctctctttgttgcttatgccgataagcatgggtttccttggtgcagtgtgtttttatatatgtataaatctatatataatctatacatatatatatacaagccagtgtataatgttataaaatggaattctaagttattaattgtaatctgtaggtgacctcggtattaacgtgaaaaacattcaaaacaagcaaaaaaagggacaaaatggaaaaaaattagactatgcgcgcattgtacttatcaggtttagagattaaatatattggaaactcgggatgaatcctgcccacctgcccctcttgcctgcggctggtctgtccctaaggagccgtcaaggtgcgcactgaagcaggaacagagcgacgtgtgactgagccagaaccgcccgctcgcgggcccatcctcgcctcccgggactcgccaaacgccctgactgaagggcccgcagcggaaaacgctgctgcagagcagcactttgtgctttcctttgcatagatatgagctagaaataaatgttattttctaagaaaacaa

SEQ ID NO: 127463 - DNA, 2840 bp, Homo sapiens
  Payload ID: 4946
  Gene Symbol: DMRTA2
  Gene Name: DMRT-like family A2
  Uniprot ID: Q96SC8
  ENST ID: ENST00000418121
  CDS Start-End: 97-1725
gcttgggttcctcaaggcggcgctttggcctagcgcgcggtgtgctcctcaccaggtctctcccctctcccaccttctttcccgtcaggtcctgtcatggagctgcgctcggagctgcccagcgtgcccggcgcggcgacggcggcggcggcaacagcgacggggccgcctgtggcgtcggtggcgtcggtggcggcagccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcgggggacctggagcgggagcgcccgcggggaccggaggcggagcagctggcgcagggggctcagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgccgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgtcttctcactctaaggtggtttttgggttttgtttaggagggtgggtggggaaggctgagcaaagggggagcagctacagacaggtgcaggtgttctcggagggggtgcgcggcctgggtcctcatctcctacctccggatccctcttccagcctcacccggccccctttccaaaaggctgggaattcatgagaattcagaggctgcgacagcagcgcaggctcctgcggctccttagctgtgctcatccggctctcagtggatggcaggataatccgagagtcttttctgtgtctccccagccctcacttttaaaaaatttaaatattcgctctaacaaatataaatttaggatgtataaatctcttggcactgagtctttgggacacacatatatatcgatacaattgtaaaaaaaaaaaaaggaaacaagttttaaggtgcactttcctcgttgcggtatttgtcgctctctttgttgcttatgccgataagcatgggtttccttggtgcagtgtgtttttatatatgtataaatctatatataatctatacatatatatatacaagccagtgtataatgttataaaatggaattctaagttattaattgtaatctgtaggtgacctcggtattaacgtgaaaaacattcaaaacaagcaaaaaaagggacaaaatggaaaaaaattagactatgcgcgcattgtacttatcaggtttagagattaaatatattggaaactcgggatgaatcctgcccacctgcccctcttgcctgcggctggtctgtccctaaggagccgtcaaggtgcgcactgaagcaggaacagagcgacgtgtgactgagccagaaccgcccgctcgcgggcccatcctcgcctcccgggactcgccaaacgccctgactgaagggcccgcagcggaaaacgctgctgcagagcagcactttgtgctttcctttgcatagatatgagctagaaataaatgttattttctaagaaaacaa

SEQ ID NO: 127464 - DNA, 1910 bp, Homo sapiens
  Payload ID: 4947
  Gene Symbol: DMRTB1
  Gene Name: DMRT-like family B with proline-rich C-terminal, 1
  Uniprot ID: Q96MA1
  ENST ID: ENST00000371445
  CDS Start-End: 56-1084
acttgctctgcagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcttgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatgtttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatggaaa

SEQ ID NO: 127465 - DNA, 1044 bp, Homo sapiens
  Payload ID: 4948
  Gene Symbol: DMRTC1
  Gene Name: DMRT-like family C1
  Uniprot ID: Q5HYR2
  ENST ID: ENST00000596389
  CDS Start-End: 238-621
agctctcccggaatccctttcgggaggactccttgctccagccccctgagccctggcctttggccaatgaggcagggctcatgggattgcttttgattcggaggtccgggagggagtggatgattgggcttcctgaggaagtgagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataa

SEQ ID NO: 127466 - DNA, 1190 bp, Homo sapiens
  Payload ID: 4948
  Gene Symbol: DMRTC1
  Gene Name: DMRT-like family C1
  Uniprot ID: Q5HYR2
  ENST ID: ENST00000595412
  CDS Start-End: 281-859
ctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcat

SEQ ID NO: 127467 - DNA, 1524 bp, Homo sapiens
  Payload ID: 4948
  Gene Symbol: DMRTC1
  Gene Name: DMRT-like family C1
  ENST ID: ENST00000622727
  CDS Start-End: 335-667
cctcctcctgctcctcctcctcctcctcctcctcctcctccttctcctcctcctcccggtctgagggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtcctgggaaagtagtggggtccagaaccctgggaggggcggagtttagtggatgggaagagcagaaggccttggtgggggtgggggaggaggttgagggaacagggggctgaaggggcacttgtcgtattgggaagaggtgtagtttcccagtgcctattctctcatgcactttcctttccaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataaggca

SEQ ID NO: 127468 - DNA, 611 bp, Homo sapiens
  Payload ID: 4948
  Gene Symbol: DMRTC1
  Gene Name: DMRT-like family C1
  ENST ID: ENST00000615063
  CDS Start-End: 196-611
actgtcctctcggcctggcacacagcgctccggccgccgaatgcccgtggacgcgcatctcttcccagagttcctgcttcctgggccagccaaagccgcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgc

SEQ ID NO: 127469 - DNA, 1197 bp, Homo sapiens
  Payload ID: 4949
  Gene Symbol: DMRTC1B
  Gene Name: DMRT-like family C1B
  Uniprot ID: Q5HYR2
  ENST ID: ENST00000334036
  CDS Start-End: 196-774
actgtcctctcggcctggcacacagcgctccggccgccgaatgcccgtggacgcgcatctcttcccagagttcctgcttcctgggccagccaaagccgcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataa

SEQ ID NO: 127470 - DNA, 1100 bp, Homo sapiens
  Payload ID: 4949
  Gene Symbol: DMRTC1B
  Gene Name: DMRT-like family C1B
  Uniprot ID: Q5HYR2
  ENST ID: ENST00000373532
  CDS Start-End: 95-673
agaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataaggca

SEQ ID NO: 127471 - DNA, 1042 bp, Homo sapiens
  Payload ID: 4949
  Gene Symbol: DMRTC1B
  Gene Name: DMRT-like family C1B
  Uniprot ID: Q5HYR2
  ENST ID: ENST00000373533
  CDS Start-End: 236-619
ctctcccggaatccctttcgggaggactccttgctccagccccctgagccctggcctttggccaatgaggcagggctcatgggattgcttttgattcggaggtccgggagggagtggatgattgggcttcctgaggaagtgagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgttgttgttataa

SEQ ID NO: 127472 - DNA, 458 bp, Homo sapiens
  Payload ID: 4949
  Gene Symbol: DMRTC1B
  Gene Name: DMRT-like family C1B
  ENST ID: ENST00000440247
  CDS Start-End: 157-458
accgtctgactggttctgacttgccggaggctgaggcaaccacaggctgacatcagaattagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctct

SEQ ID NO: 127473 - DNA, 472 bp, Homo sapiens
  Payload ID: 4949
  Gene Symbol: DMRTC1B
  Gene Name: DMRT-like family C1B
  ENST ID: ENST00000438696
  CDS Start-End: 281-472
ctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtg

SEQ ID NO: 127474 - DNA, 613 bp, Homo sapiens
  Payload ID: 4949
  Gene Symbol: DMRTC1B
  Gene Name: DMRT-like family C1B
  ENST ID: ENST00000481112
  CDS Start-End: 1-336
gctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatgtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtcttttt

SEQ ID NO: 127475 - DNA, 1524 bp, Homo sapiens; identical to SEQ ID NO: 127467
  Payload ID: 4949
  Gene Symbol: DMRTC1B
  Gene Name: DMRT-like family C1B
  ENST ID: ENST00000472595
  CDS Start-End: 335-667

SEQ ID NO: 127476 - DNA, 1792 bp, Homo sapiens
  Payload ID: 4950
  Gene Symbol: DMRTC2
  Gene Name: DMRT-like family C2
  Uniprot ID: Q8IXT2
  ENST ID: ENST00000269945
  CDS Start-End: 52-1155
gtctttgggcgtcttcttgactgaatctgactccattggaggctgtgatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtactgacagctcctctttctggagagccccaagggccccctagccagccccgcacacactcaactctgatactccagccctgtggcaccccagaccctcttcagctacagccacaggcctctggagcctcgtgcctggcccggacatctggcccctcagagtggcagctgcagcaagaggcagctgaagccctcgtggggctgaaagattcatcccaggctcctcgtgtgaccccttctgtgccccccaaccctgcctggatctccctgcttcacccctgtggcccaccagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaaatgatgtaaagaaataa

SEQ ID NO: 127477 - DNA, 1675 bp, Homo sapiens
  Payload ID: 4950
  Gene Symbol: DMRTC2
  Gene Name: DMRT-like family C2
  ENST ID: ENST00000596827
  CDS Start-End: 87-1343
gagcttggcggttcctctggccactttctcacagtgtctttgggcgtcttcttgactgaatctgactccattggaggctgtgatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtactgacagctcctctttctggagagccccaagggccccctagccagccccgcacacactcaactctgatactccagccctgtggcaccccagaccctcttcagctacagccacaggtcctgggaaagaagtgggatctagggccctgggaggaggttgagcctggggaaggaaaaagcaggaaactgaaggaagcaggggctgaggaacacttagagggtgggcagaagcgggggttcccagtctgcttgtctccctttcccttgcaggcctctggagcctcgtgcctggcccggacatctggcccctcagagtggcagctgcagcaagaggcagctgaagccctcgtggggctgaaagattcatcccaggctcctcgtgtgaccccttctgtgccccccaaccctgcctggatctccctgcttcacccctgtggcccaccagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatccca

SEQ ID NO: 127478 - DNA, 566 bp, Homo sapiens
  Payload ID: 4950
  Gene Symbol: DMRTC2
  Gene Name: DMRT-like family C2
  ENST ID: ENST00000596660
  CDS Start-End: 82-566
aattgttggtagtggccacaggagcaggaagcgctggacacagtgacttcacatgtttacacaaaaacctgaataagatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagaactcctgtgggcctctgctgctcagccatcccccgga

SEQ ID NO: 127479 - DNA, 3076 bp, Homo sapiens
  Payload ID: 4950
  Gene Symbol: DMRTC2
  Gene Name: DMRT-like family C2
  Uniprot ID: Q8IXT2
  ENST ID: ENST00000601660
  CDS Start-End: 266-940
aataaggggtactcgacgccccattggccacctgcctcgaaagggggaagacagtctgggcgggcaggacgtgcggagggagaggcagcggtggcgcgaggctcaactcgaagcgctattggtgggactgatagtcttgtgcgccaagaagctggcagaagggaaggggcgggacatcagttcaggatctcaaaccgcattggtcgtctgcctcggctgagagaggcgatgcttgaagttcattggtctttgtgagacaggatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagccttgtacccaactccagcctgtgccctctgcccctgcagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtactgacagctcctctttctggagagccccaagggccccctagccagccccgcacacactcaactctgatactccagccctgtggcaccccagaccctcttcagctacagccacaggtcctgggaaagaagtgggatctagggccctgggaggaggttgagcctggggaaggaaaaagcaggaaactgaaggaagcaggggctgaggaacacttagagggtgggcagaagcgggggttcccagtctgcttgtctccctttcccttgcaggcctctggagcctcgtgcctggcccggacatctggcccctcagagtggcagctgcagcaagaggcagctgaagccctcgtggggctgaaagattcatcccaggctcctcgtgtgaccccttctgtgccccccaaccctgcctggatctccctgcttcacccctgtggcccaccaggtgggccatgaaaggagaggatggatagggatggctgggaaatggagatcactgaagtacacagggactaaccaaggagatgagggggtcgacaggttgaacgtcttcaggcccaggaccccaagctcctcagcctggcccctgggattgcagttgagagttattcagtgaatcctttttatcagtttggcactcgacagcaaatttcttgatatcaaggaaagtggggcactgagaaaggcagggacttgcccaagggcatatagtgagacagtggcagggaacccaatgctctgtctctggacccaggctgcctgctgaagtctgaagtggggtctggcctgggaggaggtctgataagtgccttcaaggagcttacgttctagttagggaaattggatgccttcacaaggctcagtgacaaacctgaagaagattggaggaaccttgaagagtgagaaacacctagggggacagacagggaaagctgcgaattctcttgtccaaatagtggattgggcagactggcctggaggaaatgctagaacagagggaaaggaggctggagaggcttctgatggtggagatctggcatgccaggcttaggtgtctagaacagcaactgtatgtgaaggggagccagggaacgtttctgaactaagcaaggacaaattcagagaccctgagctttagaaagacaagtgggtggctttgatggacggtttggaggaggcaagactggaggtgggaaaattagcaaggaggtctgtgaaataatccaggagaacaatgatgaggcctggattggattcggtaaaaagagggggttgctagaaggaaaaacaggtgtgacctgatcctgccccttccttcttgcctgtagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaaatgatgtaaag

SEQ ID NO: 127480 - DNA, 556 bp, Homo sapiens
  Payload ID: 4950
  Gene Symbol: DMRTC2
  Gene Name: DMRT-like family C2
  ENST ID: ENST00000596258
  CDS Start-End: 153-556
ttggaggctgtggtaaccgtgaactagctgcacgaacacggtccctcctgcctttccgtcctcctccctcttagccggactccctaacccaggagcaggaagcgctggacacagtgacttcacatgtttacacaaaaacctgaataagatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagac

SEQ ID NO: 127481 - DNA, 559 bp, Homo sapiens
  Payload ID: 4950
  Gene Symbol: DMRTC2
  Gene Name: DMRT-like family C2
  ENST ID: ENST00000600017
  CDS Start-End: 63-559
tcgtctgcctcggctgagagaggcgatgcttgaagttcattggtctttgtgagacaggatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagaactcctgtgggcctctgctgctcagccatcccccggaagcctcgccctt

SEQ ID NO: 127482 - DNA, 11072 bp, Homo sapiens
  Payload ID: 4951
  Gene Symbol: DMXL1
  Gene Name: Dmx-like 1
  Uniprot ID: Q9Y485
  ENST ID: ENST00000311085
  CDS Start-End: 81-9164
gagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtgcatactgcaactctcctagtgcatgctttgtagccagtgatggacaatatctgagattatatgaagcagttattgatgctaagaaacttttatctgagctttctaaccctgaaatttctaaatatgttggtgaagtctttaacatcgtcagtcaacaatcaacagccaggccaggatgcattattgcattagatcccattaccaaacttcatggcagaaaaacccaactgcttcatgtttttgaagaagacttcattttgaataaccttgagaagaaaagccttggcaaagacagcattttatctaatgcaggcagctcacctaatggattttctgagaagttctacctaattgtaatagaatgcactcaagacaaccgttcactgttacacatgtggaatttacatctaaagtcaattcctgtctcattagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtggagaaactcttgatgaatgtgggttaaaatttcttttggctgttcgactccatacctttcttacaacttcccttccagcctatcgagctcaactccttcaccaaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtagctaaagcagccttttatagaaagaatgatcctttagatgctgccattttttaccttgcaatgaaaaagaaagctgtgatttggggattatatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatgatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggccaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcaggtcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaaatccaaacaccatctggcactgtctgtgaagaggctttggcagtatttggtgaagcaggaagaaattcaggaaacctttatcaaaaatatattcacaaagaaacggtgtctaaatgagatagaagcagatttgggatatcctggaggtaaagcaagaattattcataaggaatctgatatcattactgcgtttgctgttaataaggcaaatagaaactgcatagcaatcgcttccagtcatgatgttcaagaactggatgtttctggaattctggccacacaggtctacacttgggtagatgatgatatagaagtggaaaccaaaggatcagaagatttcttggttatacatgctcgtgatgatttaacagctgttcaaggtacaactccatatacacatagcaatcctggcactccaatcaacatgccatggcttggtagtacacagactggcagaggagcatctgtgatgattaagaaagccattaataatgttagaagaatgacttctcatccaactcttccttactatctgacaggagctcaagatggaagtgtcagaatgtttgaatggggccattctcaacaaataacctgttttcgatctggtggcaattcaagagttacaagaatgagatttaactatcagggaaataagtttggaatagttgatgctgatggatatttaagtttgtatcaaacaaactggaaatgttgtccagttactggaagcatgcctaagccatacctgacttggcagtgtcataacaaaacagccaatgattttgtcttcgttagttcctcctctctgatagctacagctggtctttcaactgacaatagaaacgtatgtttgtgggatactcttgtagcacctgccaatagtttagtccatgcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttcttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttgtatgtatgtatacgtgtgtgtgtgtgtgtgtgtgtgtatcttacacatcttatttgaacttagttgtatatattagcgaaaactggtttttcatgtgtttttgtgccataacaactattgccaccagaataactttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttt

SEQ ID NO: 127483 - DNA, 1835 bp, Homo sapiens
  Payload ID: 4951
  Gene Symbol: DMXL1
  Gene Name: Dmx-like 1
  ENST ID: ENST00000503802
  CDS Start-End: 69-1835
gcggctgcccgaggtccagaggaagtgtgtggacagcgcggccttcctggccggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaa

SEQ ID NO: 127484 - DNA, 11236 bp, Homo sapiens
  Payload ID: 4951
  Gene Symbol: DMXL1
  Gene Name: Dmx-like 1
  ENST ID: ENST00000539542
  CDS Start-End: 182-9328
tccggggctcgggatgagtcgcgggccccagctgagcggctccggctccaggcgcctgtcgctgcttctgccgtcgccaccgaagagcggccgccgcccctgagggaaggagggagggaagcagccgctgacccgtggcatgagctggatgcggtgtccgttgcaggactagggcgccgacatgaacctgcaccaggtgctgaccggggctgtgaaccctggcgaccactgcttctccgtgggcagcattggcgaccagcgcttcacggcttatgcatctggatgtgacattgtaatactgggaagcgattttgaaagattacagataatcccaggagctaaacatggaaatattcaagtgggatgtgtagactgttcaatgcaacaaggcaagattgcagcgtcttatggaaatgttatctccatttttgaaccagttaacctaccaaaacaaaagaaaaatttggaattatatagtcagtggcagaaaagtggccaattttttctggaatcaatagcacacaatataacctgggatcccacaggcagtcgtcttttaactggttccagctatttgcaactctggtccaatactaacttggagaagccaactgaagatgaaaatttaaataaaacagatcttaactttggagattggaaatgcatttggcattgcaaaactgcttcccaagttcatttaatgaaattttcaccagatggagaattttttgccactgctgggaaggatgactgtcttttgaaggtttggtataatgtagaaaactggcggacagctgttacttctccagatggaagttcagaaaaacaatcccaaggagaaattgacttttcttttgtgtatctggcccatcctcgagcagtaaatggattttcctggcgtaaaacaagcaaatatatgcctagggcttctgtatgtaatgtactgttgacttgctgcaaagataatgtgtgtcgtctttgggtagagacatttttaccaaatgattgtttgctatacggaggtgactgcagccattggactgaatcaattaatttaacaaataacttcaagagaaatgcttccagtaaagaacgagttcaaaatgctttagaagtaaatctgagacattttcgtagaggtcggaggagatcacttgctcttgtagcacatacgggatatctaccacatcagcaggatcctcatcatgttcacaggaacactccactgcatgccaatgcactttgccactttcatattgcagccagcatcaacccagccacagacattccacttcttccatctattacatctctgagtctaaatgaaaatgaagagaagaccggaccttttgttgtacactggctaaacaataaagaactgcattttactttgtccatggaagtttttttacagcaacttagaaaaagttttgaacaaccatcttctgaggccagtgtagaagattctaatcaggcagatgtaaaatctgatgaagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtgcatactgcaactctcctagtgcatgctttgtagccagtgatggacaatatctgagattatatgaagcagttattgatgctaagaaacttttatctgagctttctaaccctgaaatttctaaatatgttggtgaagtctttaacatcgtcagtcaacaatcaacagccaggccaggatgcattattgcattagatcccattaccaaacttcatggcagaaaaacccaactgcttcatgtttttgaagaagacttcattttgaataaccttgagaagaaaagccttggcaaagacagcattttatctaatgcaggcagctcacctaatggattttctgagaagttctacctaattgtaatagaatgcactcaagacaaccgttcactgttacacatgtggaatttacatctaaagtcaattcctgtctcattagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtggagaaactcttgatgaatgtgggttaaaatttcttttggctgttcgactccatacctttcttacaacttcccttccagcctatcgagctcaactccttcaccaaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtagctaaagcagccttttatagaaagaatgatcctttagatgctgccattttttaccttgcaatgaaaaagaaagctgtgatttggggattatatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatgatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggccaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcaggtcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaaatccaaacaccatctggcactgtctgtgaagaggctttggcagtatttggtgaagcaggaagaaattcaggaaacctttatcaaaaatatattcacaaagaaacggtgtctaaatgagtcattagaggacaacagtgaaaccatcaaaaattctatgatggaggagccaaacatcaataagatagaagcagatttgggatatcctggaggtaaagcaagaattattcataaggaatctgatatcattactgcgtttgctgttaataaggcaaatagaaactgcatagcaatcgcttccagtcatgatgttcaagaactggatgtttctggaattctggccacacaggtctacacttgggtagatgatgatatagaagtggaaaccaaaggatcagaagatttcttggttatacatgctcgtgatgatttaacagctgttcaaggtacaactccatatacacatagcaatcctggcactccaatcaacatgccatggcttggtagtacacagactggcagaggagcatctgtgatgattaagaaagccattaataatgttagaagaatgacttctcatccaactcttccttactatctgacaggagctcaagatggaagtgtcagaatgtttgaatggggccattctcaacaaataacctgttttcgatctggtggcaattcaagagttacaagaatgagatttaactatcagggaaataagtttggaatagttgatgctgatggatatttaagtttgtatcaaacaaactggaaatgttgtccagttactggaagcatgcctaagccatacctgacttggcagtgtcataacaaaacagccaatgattttgtcttcgttagttcctcctctctgatagctacagctggtctttcaactgacaatagaaacgtatgtttgtgggatactcttgtagcacctgccaatagtttagtccatgcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttcttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttgtatgtatgtatacgtgtgtgtgtgtgtgtgtgtgtgtatcttacacatcttatttgaacttagttgtatatattagcgaaaactggtttttcatgtgtttttgtgccataacaactattgccaccagaataactttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttt

SEQ ID NO: 127485 - DNA, 10672 bp, Homo sapiens
  Payload ID: 4952
  Gene Symbol: DMXL2
  Gene Name: Dmx-like 2
  Uniprot ID: Q8TDJ6
  ENST ID: ENST00000251076
  CDS Start-End: 289-9399
acaagcacccttgccctcccgcatttgtgcgccggtgcagcaggcagtgggaacatccgggcatttccgcagctgagcggcgacccgggcggcggcggcggtcgaggagctcccatggcagggacgaggcggagggaaggcgaaaggggggcgaggagttaagccagagcctccgcggggcgggtttccgagggaggcacagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggccatctgagttcttcttcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaatgtttaactgttagagaatttgcaagcta

SEQ ID NO: 127486 - DNA, 7465 bp, Homo sapiens
  Payload ID: 4952
  Gene Symbol: DMXL2
  Gene Name: Dmx-like 2
  Uniprot ID: Q8TDJ6
  ENST ID: ENST00000449909
  CDS Start-End: 91-7293
acagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgt

SEQ ID NO: 127487 - DNA, 10400 bp, Homo sapiens
  Payload ID: 4952
  Gene Symbol: DMXL2
  Gene Name: Dmx-like 2
  Uniprot ID: Q8TDJ6
  ENST ID: ENST00000543779
  CDS Start-End: 91-9204
acagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggccatctgagttcttcttcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtt

SEQ ID NO: 127488 - DNA, 4759 bp, Homo sapiens
  Payload ID: 4952
  Gene Symbol: DMXL2
  Gene Name: Dmx-like 2
  ENST ID: ENST00000560891
  CDS Start-End: 1-3551
aaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgagtctatagaagaacatgtggagcaggtcaaccaaaactgcatagcagaagattgccacatcaaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgata

SEQ ID NO: 127489 - DNA, 571 bp, Homo sapiens
  Payload ID: 4952
  Gene Symbol: DMXL2
  Gene Name: Dmx-like 2
  ENST ID: ENST00000559498
  CDS Start-End: 1-347
tgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatc

SEQ ID NO: 127490 - DNA, 307 bp, Homo sapiens
  Payload ID: 4952
  Gene Symbol: DMXL2
  Gene Name: Dmx-like 2
  ENST ID: ENST00000559059
  CDS Start-End: 1-231
ggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaataggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctatt

SEQ ID NO: 127491 - DNA, 5408 bp, Homo sapiens
  Payload ID: 4953
  Gene Symbol: DNMT1
  Gene Name: DNA (cytosine-5-)-methyltransferase 1
  Uniprot ID: P26358
  ENST ID: ENST00000340748
  CDS Start-End: 237-5087
tccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 127492 - DNA, 5206 bp, Homo sapiens
  Payload ID: 4953
  Gene Symbol: DNMT1
  Gene Name: DNA (cytosine-5-)-methyltransferase 1
  Uniprot ID: P26358
  ENST ID: ENST00000359526
  CDS Start-End: 181-5079
ggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacat

SEQ ID NO: 127493 - DNA, 4916 bp, Homo sapiens
  Payload ID: 4953
  Gene Symbol: DNMT1
  Gene Name: DNA (cytosine-5-)-methyltransferase 1
  Uniprot ID: P26358
  ENST ID: ENST00000540357
  CDS Start-End: 754-4596
tccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgccgcctccgctcatcgcccctccccatcggtttccgcgcgaaaagccgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacc

SEQ ID NO: 127494 - DNA, 711 bp, Homo sapiens
  Payload ID: 4953
  Gene Symbol: DNMT1
  Gene Name: DNA (cytosine-5-)-methyltransferase 1
  ENST ID: ENST00000586988
  CDS Start-End: 6-128
ccgagatgccggcgcgtaccgccccagcccgggtgcccacactggccgtcccggccatctcgctgcccgacgatgtccgcaggcggctcaaagatttggaaagagacagcttaacagaaaagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaacc

SEQ ID NO: 127495 - DNA, 973 bp, Homo sapiens
  Payload ID: 4953
  Gene Symbol: DNMT1
  Gene Name: DNA (cytosine-5-)-methyltransferase 1
  ENST ID: ENST00000588118
  CDS Start-End: 209-973
tccttgcgttgaagtccctgagtaggaggtctgttcatctgtcccctcttcttatttcctcccctggctctaagtccagcttccttcaagtgctatccctttggtctcccatggcctggacaactggccatccctggggccactgttttgccctcaggttctggatgaaagacagctggattcatggtccgtactgctgagtgagtctatgatcttggggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccag

SEQ ID NO: 127496 - DNA, 583 bp, Homo sapiens
  Payload ID: 4953
  Gene Symbol: DNMT1
  Gene Name: DNA (cytosine-5-)-methyltransferase 1
  ENST ID: ENST00000586800
  CDS Start-End: 507-583
tggtctccttgcgttgaagtccctgagtaggaggtctgttcatctgtcccctcttcttatttcctcccctggctctaagtccagcttccttcaagtgctatccctttggtctcccatggcctggacaactggccatccctggggccactgttttgccctcaggttctggatgaaagacagctggattcatggtccgtactgctgagtgagtctatgatcttgggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggc

SEQ ID NO: 127497 - DNA, 636 bp, Homo sapiens
  Payload ID: 4953
  Gene Symbol: DNMT1
  Gene Name: DNA (cytosine-5-)-methyltransferase 1
  ENST ID: ENST00000592342
  CDS Start-End: 354-636
gcggccgccctggggacgcagacgccaaggcccctccggccagggccgggagccgggccggcctagccaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagacc

SEQ ID NO: 127498 - DNA, 5215 bp, Homo sapiens
  Payload ID: 4953
  Gene Symbol: DNMT1
  Gene Name: DNA (cytosine-5-)-methyltransferase 1
  ENST ID: ENST00000592705
  CDS Start-End: 36-305
gcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgttcaagagaccctcctgcctcagcctcccaagtaactgggattagagctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccatctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaacca

SEQ ID NO: 127499 - DNA, 841 bp, Homo sapiens
  Payload ID: 4953
  Gene Symbol: DNMT1
  Gene Name: DNA (cytosine-5-)-methyltransferase 1
  ENST ID: ENST00000588952
  CDS Start-End: 485-841
cccagccccagccgcggccgccctggggacgcagacgccaaggcccctccggccagggccgggagccgggccggcctagccagggtctgactctgtcacccaggctggagtgcagtgacgtaatcacagctcaccgcagccttgacctcctgggctcaagccatcctcccacctcaatctcccaagtaggtggaactacaggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaa

SEQ ID NO: 127500 - DNA, 1775 bp, Homo sapiens
  Payload ID: 4953
  Gene Symbol: DNMT1
  Gene Name: DNA (cytosine-5-)-methyltransferase 1
  ENST ID: ENST00000588913
  CDS Start-End: 1-1169
cctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtcagtggggcggcgcccgctgggtctggacaggaaggaggcttctgtgcctgtcaccaggtggggctggggccagcgcagtcacttccgggaggacgcctgctggctgccgggtagccccatcactctcagtgggaagacggcccacaggagggacagtgctgagacatccgagtcaggctgcgtccctatgctggttccttactgtttgtttttgaggcagagattgagccagaaggacagtccgtcgcgctaaaggagcaggctaaaacccatggtggcgacagctcactcgctgtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaa

SEQ ID NO: 127501 - DNA, 672 bp, Homo sapiens
  Payload ID: 4953
  Gene Symbol: DNMT1
  Gene Name: DNA (cytosine-5-)-methyltransferase 1
  ENST ID: ENST00000586799
  CDS Start-End: 1-166
cagcaagattgtggtggagttcctgcagagcaattccgactcgacctatgaggacctgatcaacaagatcgagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttac

SEQ ID NO: 127502 - DNA, 231 bp, Homo sapiens
  Payload ID: 4953
  Gene Symbol: DNMT1
  Gene Name: DNA (cytosine-5-)-methyltransferase 1
  ENST ID: ENST00000590619
  CDS Start-End: 1-231
caggaggagcaagtccgatggagaggctaagcgttcaagagaccctcctgcctcagcctcccaagtaactgggattagagagtcttgctctatcgcccaggatagagtgcaatggcgcgatctcggctcactgcaacctccgcctcccagtttcaagcgattctcctgcctcagcctcccaactgaaccttcacctagccccaggattacaaggaaaagcaccaggcaaac

SEQ ID NO: 127503 - DNA, 591 bp, Homo sapiens
  Payload ID: 4953
  Gene Symbol: DNMT1
  Gene Name: DNA (cytosine-5-)-methyltransferase 1
  ENST ID: ENST00000592054
  CDS Start-End: 378-591
aaaatggaccgtggattcccccgtagctccctggtggctagaaactaggcggggtgggggttctcttttgatccccaaatacagcaagctttgggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtcca

SEQ ID NO: 127504 - DNA, 9501 bp, Homo sapiens
  Payload ID: 4954
  Gene Symbol: DNMT3A
  Gene Name: DNA (cytosine-5-)-methyltransferase 3 alpha
  Uniprot ID: Q9Y6K1
  ENST ID: ENST00000264709
  CDS Start-End: 339-3077
gcagtgggctctggcggaggtcgggagaactgcagggcgaaggccgccgggggctccgcgggctgcggggggaggcacttgacaccggcccggggagaggaggggccgctgtccctgcggccagtgctggatgcggggacccagcgcagaagcagcgccaggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgtactggtgctttcctgtctaagtcgccttttgtgtgttcttttatgaggcccccaccatccacccctctgtgcacaaggcggctcccggcccctggaatgtgatgtttttggtcatctccaaaggctgcagttttatactgggaggctgatgacaccttttattataattattcttatggttctggttataattatgtttgttttaagattttctttaagaaaacaaaaacccaacacccttccctttaggtttcaaaccaaggtgcgggagcagggtgcttctgagttagcggtggctctggtgccctggctcccacccctcgggccaggtgggccactgggcatggtgacagctgggcggccagggagtccccaaggtctgccttctgggcttgtcactcttctcttctacttcccctcctcttgagtcgggtgtgtcagggctggagggaggaccggccgtctctctccttgtgtgtgtgattggagtggtgtgtatttcttttctagtacttggtctgatgatagctgtgctcttacctcgagtcagcagcacctggagccccaagtgctcaacactttgttctacttcctacaaggcaggcggcctggcgtcagtagtaggaagggatggcattgttggctccagggtgagggcccgacgggcaggtgcttgcctgggtagatggggtgtagatatgtggcatatagagatatatattttataatgggaggggggatggcacctcctgggactggtagagctgggaggtgtgtcggcaagcacatggccccaagtccacgtccctagaaagatggggcctacagtgataggcgctctataaatacatagatagggtcatgtttaagaaatattatggggtggggagtgggggaagcaggcttagtgtgctgagcctcggtccccactgcagacctaaaccccacaccaatcagtcaatctcacacgcatacacaggagcatatttctgtactgatgcataatgaatgcactcacacacacacacacacgccagggggctcccagcactcttctcccagggttcaggactttgtggagtcagcccgtgcagctatttacctctgttgccctgattgcaggtagactgtcaatcccagaagttgctaggtgctgaggcaggaaaaggaggaggtttcttttagcaggtgctctcctctagcaggtagtgttctatctcttttgcccctggtgatgtcaaaagattcttctgttagcaacctgtgatactgacctgcaactctaggcaccagtcaagtcagccctcaactccccctacctattctccccaactgaaatcaaattgacatccaggtctgtcttggccagggggcttccattggggaaaaaaaatgggacagtgaacctcacctattgaataaaccaaattagtaattagtgacaaaaccaaaccaaggctttggaccccctgctcattactcaggagtaaattcacacagctggtggccggtctcacccctttttggggtgcttggtcctggaccccaatctactgtctcctcgacagattggtgtttaagatcatgcccagttgcttcctgtcacctcttgacaggtggtgactgggctgctgtggggctggagcagcgaggaagggagcctctgccccctcagtggagtccctgtgctaactgtggtgctcacccagctcctccttgctcccgcggggctctgtccttcgggcctggagtccaccagcgccactccaggagggctgggggaggaggggctgcctcaggcagtccaaggtgctccctcccccgctggccaatgctaaggtcttcccggctcccagggtcaggacagagtcttctaaggctcaggctctcccaagccactgcttagtgacagttagcctttcccagcggcccaagctccaccggaactgggcctggtgctccaaccaaagggttggtgttgggacttgggaagagacttggtagccaagggcatggcaagcctgggggattcctgtgggccggcttgctcgaggagggagtgctgggcacagaggagcccttatggctgacagcttgagagcacttgttcctccagatctagccacttgaccaggccctagaatggaccagatgccccaggggtcatggcccccccccccccccccttgcagggacgagagttaacaatcaccagcttttcttccggcccagcctgtgtgcttggtctcacagtagaatttaggagagtgtggggctttgggattgtgccaacttggccaagctgagatatgcttaatccacctcaacgctggggcctctggggacaggtattgggtcaccttccaaggggtgctgaacttcagcaggctgtagataaggcagaggttagaggcagtggagtgggggaaccaagaaggcctagggaaaattgccaggcatattccctgtggaattttctttccgaagagtaggcccatttcccccttagaaacaagggttctgggggctgatgacagcttcccctgcaggtgccaggtggcgcatgatgccaaagagatccgtggctcttgcctgggggaggtagccaggtgctcgtgctggggacacagtccttggcctcctgcctaagcaggaagctagtttccagcaggcggctggtactaaccccccgccccacgggagcgacaggctggtgcaccggcagactggggggccgcaggcgggcactagcaggggtctgcagtccatagatgatgacatgaatctgttgctgtccttttgtctctaggccccagagacttcttgctattgaacatcctattggaaagcaaactttccaagagagcacccgggacctgttagcttttgaaacaggcctgggtgtgattgactggtagagatgcctgtgtgatttttggcgcattgcaggagtgtggattgggacaggcaccccagcaggaaggaaggctgacaccaaaggggtctcacagggcccagctccccttgcttcccgataattggccaccaggccatggcgactctggggaagcctagatgggaacacccaccttctccagcagtagaaggaatatttcagcagagccatctgggagatgttcttataggaaaactgcagtcattcatttcatagttttgcttatataaatagagtacatttgggaggcagttttgaattcctgttgctactctgcttggtgcggagttgcagtggccccaagtgtctttcagagctgttgcttttaggatccccctcaagctgtgggttagggccagggcagggagggggtgctgcctggcactgtgccctgaagagggctgcttgcttcctttggtcgggagcacggcagagccaacattctggtgggaaccgagtttctagccaggcccctgttttggtcccgggaggtgagtaatctgagtttgtcattgcgtattctccacgctgcctgctctcagtgctggagactagagagcgaccctggagttgtcctctgggagtcctgcctgtttgccagggagcagctgaaacctccccgctcccaatcccgggggtggaaaaggtgtagtggaggaatggtctggagctgggatggcccttctggccatgccctgctgagccaggattaaggaaagtgtcagccgcctccttaccaggccctgtgctggggtcaggaggaccgggaggagagggaaggggtgagaggatggactctgctgttgtagtgtgagctctggaatctttacgttttggtaaaggcaggccagggtctttgaggatcgagttggggaaccttgcctctgtgtttccgagacccagctaaggtgggcctttggtgggtgacctgtctctgacccgaggcagcagagttttgggggagggagaaacaagcaaggagcagggaggacaaggacacaagatccctttgctggtggtgacttactcacttcccccaccagagggcctgggactcccgaaactcccgtaactggaaagctccctggctcagctccactggggggtgaggagggcggctccctcagccccagcctagcggcctccaaccctgtgcctgagaacatgagcagcggtctaaagcatcccctagtcccatttcacttcacagaccgatttggttgcacagccctagaattcaacagacaacaaaaatgctgaaattccttagaatacgcagagggaggaggtgactcaccaaggtgctaaaacattttattaaaaatatatattgttaaattaagtctgctgtctggacaatgactgtttgttttgttttcttgtagtggagtttaaaagagactattattttactctgatatattattattaaaaaggcattttaactttgtacttgaaaactaaatgagcgatttcatgtgttttagctgaggcattgaagtagcgggtgcttacttatttgtgggaaatcatgtattcatactgaagaataaactccgtagctgatttggtaataacttttactgttacagacgatttcgctttgaccccggtggcagagcacttttactccacattccacgcagctaaatgcaggacttcccagactcttccctccccagccctctttcctttctcttaagttcctcttttctcctttattattattatttttttttcctggttccagcatcctttcaccactgtattttttttttttttttttttttttttttttttttttttttttttttttttttagggttgcttctctatttattgacaataataatgtacatttcacagtctggttctaggacattcagggaagggcgagtgggggcccgaggggtccctgccccacccgcctggtgtcctgttgtatctctgtgtaagtgatgctcgtgacatagctgtttatgaaataattaaagaggtcaatgcgtacaacagatgtagaaagtctgtcagttccgccttcatcacatttttttttgtgcccagaagaatataataaagctcctttctaatgtacttgtgctggagaacacttgaataaatggactgtttttgtgcaaaaagaaaaatggaaaagcaccgtaataa

SEQ ID NO: 127505 - DNA, 4279 bp, Homo sapiens
  Payload ID: 4954
  Gene Symbol: DNMT3A
  Gene Name: DNA (cytosine-5-)-methyltransferase 3 alpha
  Uniprot ID: Q9Y6K1
  ENST ID: ENST00000321117
  CDS Start-End: 238-2976
gacgcggcgccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 127506 - DNA, 3589 bp, Homo sapiens
  Payload ID: 4954
  Gene Symbol: DNMT3A
  Gene Name: DNA (cytosine-5-)-methyltransferase 3 alpha
  Uniprot ID: Q9Y6K1
  ENST ID: ENST00000380746
  CDS Start-End: 115-2286
ccgcccccagccccatcgcccccttcccctcccccaagacgggcagctacttccagagcttcagggccgcggctcacacctgagcgcgactgcagaggggctgcacctggccttatggggatcctggagcgggttgtgagaaggaatgggcgcgtggatcgtagcctgaaagacgagtgtgatacggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgta

SEQ ID NO: 127507 - DNA, 4477 bp, Homo sapiens
  Payload ID: 4954
  Gene Symbol: DNMT3A
  Gene Name: DNA (cytosine-5-)-methyltransferase 3 alpha
  ENST ID: ENST00000380756
  CDS Start-End: 238-2583
ggggccgctgtccctgcggccagtgctggatgcggggacccagcgcagaagcagcgccaggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgaggtacaaaatagccacctgtactagtgggctagtggccactgaattgaacagtgtagaggacaacccaccatcgcagaagttcatttggacaatgctgatctagaacgttccagtgacagcttgtggaatgtggctaggtgtaattccagcttctcctggaggctgcaggctagcccagtgtgtggctcctgagagagaatccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaacatgaggatggagagaagtatcagcacccagaagagaaaaaggaatttaaaacaaaaaccacagaggcggaaataccggagggctttgccttgcgaaaagggttggacatcatctcctgatttttcaatgttattcttcagtcctatttaaaaacaaaaccaagctcccttcccttcctcccccttcccttttttttcggtcagaccttttattttctactcttttcagaggggttttctgtttgtttgggttttgtttcttgctgtgactgaaacaagaaggttattgcagcaaaaatcagtaacaaaaaatagtaacaataccttgcagaggaaaggtgggagagaggaaaaaaggaaattctatagaaatctatatattgggttgtttttttttttgttttttgttttttttttttgggtttttttttttactatatatcttttttttgttgtctctagcctgatcagataggagcacaagcaggggacggaaagagagagacactcaggcggcagcattccctcccagccactgagctgtcgtgccagcaccattcctggtcacgcaaaacagaacccagttagcagcagggagacgagaacaccacacaagacatttttctacagtatttcaggtgcctaccacacaggaaaccttgaagaaaatcagtttctagaagccgctgttacctcttgtttacagtttatatatatatgatagatatgagatatatatataaaaggtactgttaactactgtacaacccgacttcataatggtgctttcaaacagcgagatgagtaaaaacatcagcttccacgttgccttctgcgcaaagggtttcaccaaggatggagaaagggagacagcttgcagatggcgcgttctcacggtgggctcttccccttggtttgtaacgaagtgaaggaggagaacttgggagccaggttctccctgccaaaaagggggctagatgaggtggtcgggcccgtggacagctgagagtgggattcatccagactcatgcaataaccctttgattgttttctaaaaggagactccctcggcaagatggcagagggtacggagtcttcaggcccagtttctcactttagccaattcgagggctccttgtggtgggatcagaactaatccagagtgtgggaaagtgacagtcaaaaccccacctggagcaaataaaaaaacatacaaaacgt

SEQ ID NO: 127508 - DNA, 2300 bp, Homo sapiens
  Payload ID: 4954
  Gene Symbol: DNMT3A
  Gene Name: DNA (cytosine-5-)-methyltransferase 3 alpha
  ENST ID: ENST00000402667
  CDS Start-End: 149-2218
ccgcccccagccccatcgcccccttcccctcccccaagacgggcagctacttccagagcttcagggccgcggctcacacctgagcgcgactgcagaggggctgcacctggccttatgggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagttaaacaaacaaacaaaaaacacaaaacataataaaacaccaagaac

SEQ ID NO: 127509 - DNA, 1775 bp, Homo sapiens
  Payload ID: 4954
  Gene Symbol: DNMT3A
  Gene Name: DNA (cytosine-5-)-methyltransferase 3 alpha
  Uniprot ID: Q9Y6K1
  ENST ID: ENST00000406659
  CDS Start-End: 339-839
gcagtgggctctggcggaggtcgggagaactgcagggcgaaggccgccgggggctccgcgggctgcggggggaggcacttgacaccggcccggggagaggaggggccgctgtccctgcggccagtgctggatgcggggacccagcgcagaagcagcgccaggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggtgagtcctcagcaccaggggcagcctcttctgggcccaccagcataccctgagagtcagggacttggctctccagcaggtcccaggaaggatggtctgggtcgtggctaaaggtctgcttgccaaggctatggcctggaggctactggctggatgcagcctgcgcatatgttttatttggcccatagagtgttttaaacatttaaaaaattagttgccagtatttaaaaatcaaaaaatttcacataaaaatctggagttttggcttctcatgaaaaaaaaaaaagctagatctggcaacagcgggctttcataacgccaacgattgctagactgggataatggcggtccctccatcgccttctgtggctggttgtgggccttagttttctgcagctctacctggcctgcttactctcccacgtgccatgcagttcctgggggttgctgtatttgtagcccctggcctgggcactcaagggcagcagataccctgtttgcctccctgagtgcagaggtcctgagcccaccctagttgggctgactcaactggaaatttggttgtgacagtggcgtggggagagggctgggtgattgtattctgtgtactgcccagcccaggcctcttcatctggggactttttggcctaaccctggaagcctggaaagttgcccacttttctctttcaggttaagccagcaatttcagggccaaccgagctgtaaacatgttagtaatgaggacaactagcatttgtacagggcttcacagtttacaaagcgctttctcatacattatcacatttgatcctcccagggccctgccaggttgttttgcatatgtgcattttaatttcaaaaagtcttccttccaagcgtgtatgatgaaatgagtaaattgattaattggcgtaacttattttgcatggatccaacctaatgttcatgcaggatagagaacatttccagaatacaaatttccaaactta

SEQ ID NO: 127510 - DNA, 4255 bp, Homo sapiens
  Payload ID: 4955
  Gene Symbol: DNMT3B
  Gene Name: DNA (cytosine-5-)-methyltransferase 3 beta
  Uniprot ID: Q9UBC3
  ENST ID: ENST00000201963
  CDS Start-End: 265-2802
gaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 127511 - DNA, 4237 bp, Homo sapiens
  Payload ID: 4955
  Gene Symbol: DNMT3B
  Gene Name: DNA (cytosine-5-)-methyltransferase 3 beta
  Uniprot ID: Q9UBC3
  ENST ID: ENST00000353855
  CDS Start-End: 283-2784
cgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 127512 - DNA, 4336 bp, Homo sapiens
  Payload ID: 4955
  Gene Symbol: DNMT3B
  Gene Name: DNA (cytosine-5-)-methyltransferase 3 beta
  Uniprot ID: Q9UBC3
  ENST ID: ENST00000328111
  CDS Start-End: 322-2883
acccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 127513 - DNA, 4048 bp, Homo sapiens
  Payload ID: 4955
  Gene Symbol: DNMT3B
  Gene Name: DNA (cytosine-5-)-methyltransferase 3 beta
  Uniprot ID: Q9UBC3
  ENST ID: ENST00000348286
  CDS Start-End: 283-2595
cgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 127514 - DNA, 2674 bp, Homo sapiens
  Payload ID: 4955
  Gene Symbol: DNMT3B
  Gene Name: DNA (cytosine-5-)-methyltransferase 3 beta
  Uniprot ID: Q9UBC3
  ENST ID: ENST00000443239
  CDS Start-End: 111-2297
attcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagcttccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcag

SEQ ID NO: 127515 - DNA, 2315 bp, Homo sapiens
  Payload ID: 4955
  Gene Symbol: DNMT3B
  Gene Name: DNA (cytosine-5-)-methyltransferase 3 beta
  Uniprot ID: Q9UBC3
  ENST ID: ENST00000456297
  CDS Start-End: 65-2149
agccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcag

SEQ ID NO: 127516 - DNA, 1706 bp, Homo sapiens
  Payload ID: 4956
  Gene Symbol: DNMT3L
  Gene Name: DNA (cytosine-5-)-methyltransferase 3-like
  Uniprot ID: Q9UJW3
  ENST ID: ENST00000270172
  CDS Start-End: 485-1648
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctca

SEQ ID NO: 127517 - DNA, 1014 bp, Homo sapiens
  Payload ID: 4956
  Gene Symbol: DNMT3L
  Gene Name: DNA (cytosine-5-)-methyltransferase 3-like
  ENST ID: ENST00000431166
  CDS Start-End: 151-1014
ggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggag

SEQ ID NO: 127518 - DNA, 603 bp, Homo sapiens
  Payload ID: 4956
  Gene Symbol: DNMT3L
  Gene Name: DNA (cytosine-5-)-methyltransferase 3-like
  ENST ID: ENST00000436357
  CDS Start-End: 1-545
cagctcctccctcggggttgcctgtctgtctcttccccactctaggcctgcctgggggaggaggggtccatgcacctctgtggccccagcactgggcagggcttcattgctgctggagggacaggggcagggggatccctcagacccaggccggctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctca

SEQ ID NO: 127519 - DNA, 1364 bp, Homo sapiens
  Payload ID: 4956
  Gene Symbol: DNMT3L
  Gene Name: DNA (cytosine-5-)-methyltransferase 3-like
  Uniprot ID: Q9UJW3
  ENST ID: ENST00000628202
  CDS Start-End: 159-1319
gtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaag

SEQ ID NO: 127520 - DNA, 4468 bp, Homo sapiens
  Payload ID: 4957
  Gene Symbol: DCLRE1A
  Gene Name: DNA cross-link repair 1A
  Uniprot ID: Q6PJP8
  ENST ID: ENST00000361384
  CDS Start-End: 919-4041
ggactctgagggctttttggagctcgctatgcttaacctggagatgattaaggccccgcttcctggcctcccagcctctaatgccaaaagataagggagaggctggcgtgtgaccccgttttgagtcaggtggacagagggctggccaccttcggaaccatgggtgcaatacggagtcagacctcaatacaagcccactctttcacatatttgaacttttttcacatatcaactttttttgttcactgtgcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaatttg

SEQ ID NO: 127521 - DNA, 4241 bp, Homo sapiens
  Payload ID: 4957
  Gene Symbol: DCLRE1A
  Gene Name: DNA cross-link repair 1A
  Uniprot ID: Q6PJP8
  ENST ID: ENST00000369305
  CDS Start-End: 696-3818
cgggaacttgttcccgccaagaccctaaagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaaaaagagccgcagaagctaaagaggtgaaggaccatgaagtgccccttggaaatgcaggttgtcagacttctgttgcttctagtcagaattcaagttgtggagatggtattcagcagacccaagacaaggaaactactccaggaaaactctgtagaactcaaaaaagccaacacgtgtccccaaagatacgtccagtttatgatggatactgtccaaattgccagatgcctttttcctcattgatagggcagacacctcgatggcatgtttttgaatgtttggattctccaccacgctctgaaacagagtgtcctgatggtcttctgtgtacctcaaccattccttttcattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttaaaaagtctccgtctctgactgaagccagtgaaaagatttctactcatatccaaacatcccaacaagctctacaatttacagattttgttgagaatgacaaactagtgggagttgctttgcgtcttgcaaacaactcagaacacataaatttgccattgccagaaaatgacttcagtgactgtgaaatctcctattctccacttcaaagtgatgaagacactcatgatatcgatgaaaaaccggatgattcacaagaacaactgttttttaccgaaagctcaaaagatggcagcctcgaagaagatgatgacagctgtggtttttttaaaaaacgacatggtcccttactgaaggaccaggatgagagctgccccaaagtgaacagcttcttaactcgggataagtatgatgaaggattgtatagattcaatagtctaaatgatttgtctcaacctatttctcaaaataatgagagtactttgccttatgatctggcatgtactggtggtgattttgtgttgtttccacctgcattggcagggaagcttgctgcttctgttcatcaggcaactaaagcaaaacctgatgagccagaatttcactcagctcaatcaaataaacagaaacaggtaattgaagaatcatctgtttacaatcaagtttctcttccgttagttaagagtttaatgttgaaaccttttgaaagtcaggtagaagggtatctttcttcccaaccaacccaaaatacaattagaaaattatcaagtgagaacttgaatgctaagaataatactaactcagcatgtttctgcagaaaggcattagagggtgtgccagttggtaaagctacaattttaaatacagaaaacttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataaacttaaatccagttccaagtcctaatcaaaagaggtcctcgcagtgcaagaggaaagcagaaaaatctttaagtgatttagaatttgatgcaagtactttacatgagagtcagctttctgtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggaaccggctttacagttgatgcctttcagtatggcgtggttgaaggttgcacagcctattttctcacacattttcattctgatcattatgctggattgtctaaacacttcacatttccagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctaatggtactgtcatattacacacgggagacttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttctcccaatgatgcaaattaattttaagggcttacagagtcatttgaagaagtgtggtgggaaatacaatcagattttggcatttcgacctacaggatggacacactctaacaagttcactagaatagcagatgttattccccagaccaaaggaaacatttcaatatatggaattccttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcagtagtagttaagttccttggatgtagcttgttagtagttaaatctatagaaatgtgaaatacactttgtgtggaaaaacctcatgaagattgttcagatactttattttctcatttatgtttgaacaacatgttcgtggtgctgaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcattatatatataagtaattatgtgtctttaaaattatgagatgaaacttttatatgacgtgtatacttaaataaaattaatataaaa

SEQ ID NO: 127522 - DNA, 3940 bp, Homo sapiens
  Payload ID: 4958
  Gene Symbol: DCLRE1B
  Gene Name: DNA cross-link repair 1B
  Uniprot ID: Q9H816
  ENST ID: ENST00000369563
  CDS Start-End: 447-2045
accaaacagaagaccgctgccggtctccccgcgagcgagcgctaagcgtagtcccgactccgaccttaggatgcccttcccccaacctctcactctccaggcgcagctgcgcggctccctctggtggagctgcggcgggcaatcggaaatcggctactttggcctgtctcctccctgcagcgcgcgctttgagtgcccggctcggcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggttctctttagcttctggttcttgaaagaaattaatctgtatataacataagaaactttgaaagtcaaaaaaacaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcata

SEQ ID NO: 127523 - DNA, 2228 bp, Homo sapiens
  Payload ID: 4959
  Gene Symbol: DCLRE1C
  Gene Name: DNA cross-link repair 1C
  Uniprot ID: Q96SD1
  ENST ID: ENST00000357717
  CDS Start-End: 253-1986
ggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaaa

SEQ ID NO: 127524 - DNA, 833 bp, Homo sapiens
  Payload ID: 4959
  Gene Symbol: DCLRE1C
  Gene Name: DNA cross-link repair 1C
  ENST ID: ENST00000378241
  CDS Start-End: 581-833
gcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaatttgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctga

SEQ ID NO: 127525 - DNA, 1933 bp, Homo sapiens
  Payload ID: 4959
  Gene Symbol: DCLRE1C
  Gene Name: DNA cross-link repair 1C
  ENST ID: ENST00000378242
  CDS Start-End: 676-1713
aggagtaaataagtgcaattcttttgttgttcttttttggagatgaggtgtctctgtgttgcccaggctggcctcaaatccctgggcttaagcaatcctcctgcctcagccttgagtagctgggatcacagacatgtaccactgtgcccagctaagaaatgcaattctgagaccttgggtttttgtgtatattatagttaatgcccagctaaattctaacttatttgaaaagggatttgttaaacataagcaactgaccttcttggacaaggaaagcaatatattaaaaaagagaaaaaaaaaagaatctttgagtcccattggtgattctcagctcttactgtggatcagaatcacctggggaatatttaaatgtactgatttctaggcccactagtactcagtgttcaggagatctttgggagtgaggcccaggcattggatatttttttcccaagaggtccctggtgatccccacgtgcagccagcattgagaaccacagccataagagagttctgcttctctttccccagcctccctttatctcccctaacaacctgtttcatcgtagagattgttgatccatgtgattttcctttttctagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttac

SEQ ID NO: 127526 - DNA, 2637 bp, Homo sapiens
  Payload ID: 4959
  Gene Symbol: DCLRE1C
  Gene Name: DNA cross-link repair 1C
  Uniprot ID: Q96SD1
  ENST ID: ENST00000378246
  CDS Start-End: 375-2108
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaaagccaggcatggtggtgggctactctggaggcccttgaggatcacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 127527 - DNA, 2246 bp, Homo sapiens
  Payload ID: 4959
  Gene Symbol: DCLRE1C
  Gene Name: DNA cross-link repair 1C
  Uniprot ID: Q96SD1
  ENST ID: ENST00000378249
  CDS Start-End: 276-2009
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagcttgaaggtttatctatactgttcacctgtgactaaggagttgttgttaacgagcccgaaatacagattttggaagaaacgaattatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 127528 - DNA, 2485 bp, Homo sapiens
  Payload ID: 4959
  Gene Symbol: DCLRE1C
  Gene Name: DNA cross-link repair 1C
  Uniprot ID: Q96SD1
  ENST ID: ENST00000378254
  CDS Start-End: 530-2248
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagacacacctgatcacatacaagcgcgtatttccaagtaacaatggtgagggaccactgttggaggaggtccagggacaccgtgtttccacccccaccttgtgctcttggtggcactgaaatggtgtgcatagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 127529 - DNA, 2807 bp, Homo sapiens
  Payload ID: 4959
  Gene Symbol: DCLRE1C
  Gene Name: DNA cross-link repair 1C
  Uniprot ID: Q96SD1
  ENST ID: ENST00000378255
  CDS Start-End: 852-2570
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagacacacctgatcacatacaagcgcgtatttccaagtaacaatggtgagggaccactgttggaggaggtccagggacaccgtgtttccacccccaccttgtgctcttggtggcactgaaatggtgtgcatagcttgaaggtttatctatactgttcacctgtgactaaggagttgttgttaacgagcccgaaatacagattttggaagaaacgaattagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 127530 - DNA, 2463 bp, Homo sapiens
  Payload ID: 4959
  Gene Symbol: DCLRE1C
  Gene Name: DNA cross-link repair 1C
  Uniprot ID: Q96SD1
  ENST ID: ENST00000378258
  CDS Start-End: 508-2226
tcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 127531 - DNA, 2354 bp, Homo sapiens
  Payload ID: 4959
  Gene Symbol: DCLRE1C
  Gene Name: DNA cross-link repair 1C
  Uniprot ID: Q96SD1
  ENST ID: ENST00000378278
  CDS Start-End: 39-2117
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 127532 - DNA, 3532 bp, Homo sapiens
  Payload ID: 4959
  Gene Symbol: DCLRE1C
  Gene Name: DNA cross-link repair 1C
  Uniprot ID: Q96SD1
  ENST ID: ENST00000378289
  CDS Start-End: 423-1727
cggaacgaagaatgatttctaagcgcagttccgcagcccactcacctcgtcggctggggccacctgctctgggagtttcgatttcccttcccgcgactgcacctccacagacatgggcaacgccttaccagagcaacacctgtgtttgttgggcgggaatgagccttgcactgggcagggctcagggcccatcgcgtgcagcgaagcgcgggtgatttaaacccaagcagcgggcgcctagaacccgaccggatgctccttgactttgcccccggtctccggactcctctgattggacgtggctgcgttcggccgcccaatggcgaggcagcgcgcggcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagggtctcactctgtcactcaggctagaatgcggtggtgccatcatgactccctgtatcctttaactcctgggatcaagcgatcttcctgcctcagcctcctgactagctggatcacaggtgcataccgccatgcccagctaatgatttagtttttatagagatgtggggtctcactatgttgcccacactggtctggaactcctgggctcaagtgagcctccagccttgacctccccaagtgctgggattaactgtaactggttgatttatgactttttaaacaggatttgagcagtacattggaacactgcattactttcattataattaggatgttcaaaaagctatacaactatagctctctacaggacacaactgaatgttaaggactaaatctgcaagtatatgctctaaatatgatccaggcacatttttcctataacttatatatatgcagttacaaatggaaaattgttaaaaatacaggggagaagctatgttaactttggaatggaaggttttgtttttgtagaatatgttattttcatgcaattctgtaagtctaagatcgtcatctacagttctgctcttaagaacacaagttttatgacacgctcggcttaagaaaccaaaagtgtctaaagtactttatgttaccaaccaaatttggctgctgcactcattaagaatgcaacttaaaaaattttggttaacaaaaagagtaatttgattatacaagatcttgtatactgaataatttataataatctaccactgtctaaaagtgtaagaatcaaaacagccatctaatttagtttcagaattatagatgaatacagataattataggtgacccaattccaactaaaaaatccagagttgacaactccagatatgtagccatgcttgtgtctttctagtcacagctcaacctacccttcagtttgaagcagtgtggtgccatggtgaagactactgattttagagctttgaatctcggttcttattactatgtgacctgtgtgaccttgggcaaggtactcaatttctctacaataatggacataacagtactacttctcaaaaaaaaaaaaaaaaaaaaaaaaaaaagaaacagtactacctcactgagttttggagaggattagtgaattaatacatcaagtgcttagaatagtatgtgacacacggcaaatactttttacatttatatatatatatacatatatatgatttgtatacaaataaatttgctagtatttgtatggtagttttgagaatggtcttcacagttcaaaagtaagttacagattatggatgcaataaatgcttgtgtatattttacaaaactcataaatatagtatctttcatgttgatccaaaatagagttctgccaactacatttaatcatatttggtcaaatagatgaagtaaattaaaactttcaagtttcaaagcagcatgtgttacatctgagtttcttcttaggacttttgggtaaaaacagttgtcatattttaaattttacaaatcctaggtttgactagtaggaatgtgtatttgttgaaagatgactatatcaatttgttttaacgtatattttttattcatataaaagttttttatttctaaatatgccagtgaactcttctcctaaatctgaataaatttctacatatctgcaaatgaaaatatcaaaatgtaccaagtatctcttaaagagataaaaaggtaattttccaaaagtataaaccttgcatgtccatcatttactacgtggcaaatgaaacatacctctccaacatattccatgacaaaactcattcttttaatcttcacaagggtctttacaccccagccacgtccattgctagttcgaaagatgcaaagcgaatactgtgtgcctttttgtacaatcctattgggacaatcaggaccacactgacaccttga

SEQ ID NO: 127533 - DNA, 2761 bp, Homo sapiens
  Payload ID: 4959
  Gene Symbol: DCLRE1C
  Gene Name: DNA cross-link repair 1C
  Uniprot ID: Q96SD1
  ENST ID: ENST00000396817
  CDS Start-End: 806-2524
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 127534 - DNA, 901 bp, Homo sapiens
  Payload ID: 4959
  Gene Symbol: DCLRE1C
  Gene Name: DNA cross-link repair 1C
  ENST ID: ENST00000418843
  CDS Start-End: 550-901
gactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagacacacctgatcacatacaagcgcgtatttccaagtaacaatggtgagggaccactgttggaggaggtccagggacaccgtgtttccacccccaccttgtgctcttggtggcactgaaatggtgtgcatagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaat

SEQ ID NO: 127535 - DNA, 877 bp, Homo sapiens
  Payload ID: 4959
  Gene Symbol: DCLRE1C
  Gene Name: DNA cross-link repair 1C
  ENST ID: ENST00000456122
  CDS Start-End: 706-877
ggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagat

SEQ ID NO: 127536 - DNA, 3367 bp, Homo sapiens
  Payload ID: 4960
  Gene Symbol: DDIAS
  Gene Name: DNA damage-induced apoptosis suppressor
  Uniprot ID: Q8IXT1
  ENST ID: ENST00000329143
  CDS Start-End: 51-3047
tgccagtcatcccaatggctattttgttttgcagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaacc

SEQ ID NO: 127537 - DNA, 870 bp, Homo sapiens
  Payload ID: 4960
  Gene Symbol: DDIAS
  Gene Name: DNA damage-induced apoptosis suppressor
  ENST ID: ENST00000532764
  CDS Start-End: 194-870
agattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagatgtatcaaatgagcacactgaaatctaataaagtgatatttcagctaaaaaagaacaatttccaccaatttaggttctttaaaagattcatatggagttttgctcttgttgcccaggctgaagtgccatggtgcaatctcggctcactgcaacctccgcatcctagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagat

SEQ ID NO: 127538 - DNA, 3278 bp, Homo sapiens
  Payload ID: 4960
  Gene Symbol: DDIAS
  Gene Name: DNA damage-induced apoptosis suppressor
  ENST ID: ENST00000528759
  CDS Start-End: 242-442
aaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaagaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaacc

SEQ ID NO: 127539 - DNA, 560 bp, Homo sapiens
  Payload ID: 4960
  Gene Symbol: DDIAS
  Gene Name: DNA damage-induced apoptosis suppressor
  ENST ID: ENST00000528262
  CDS Start-End: 191-560
aaactgtcatggcgctggtggcagtgtagcagtgaggacaaccagaggtcactctcatcaccatcttagttttgggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggac

SEQ ID NO: 127540 - DNA, 889 bp, Homo sapiens
  Payload ID: 4960
  Gene Symbol: DDIAS
  Gene Name: DNA damage-induced apoptosis suppressor
  ENST ID: ENST00000532277
  CDS Start-End: 664-889
gtgactgtcgtgtccaattacagaaaagcctgaatcaagagtatgcagccaaaactactaccaaattattggtaatgggaggagaaaatttaaacagaactgggatttgggaccaccttctggaagatgttagccaaaaaccgaacagatcctaggcatcaaggggtgtgaatttcgagtcaccccgccagaccccagggcgctgcggctcactccacactttcccgggaaccctacgcccaggaggctcagcgaagctccaaaaccaattttacggactgtactactgatccacctgtcggggagaaagactctacccgcagtttgacgaaaatggtcgtttccagatgcttgtaggatttcctcgctaagctccaccctctgcggcgccttcttctgattggctctgagtaatcagagccaaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttg

SEQ ID NO: 127541 - DNA, 331 bp, Homo sapiens
  Payload ID: 4960
  Gene Symbol: DDIAS
  Gene Name: DNA damage-induced apoptosis suppressor
  ENST ID: ENST00000532589
  CDS Start-End: 104-331
gattggaaggctgccggcgtgctactgagttcggccggtccgagtcactgtgcgtcgcctgggcccgttcctggtcttctcccccagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttgga

SEQ ID NO: 127542 - DNA, 3533 bp, Homo sapiens
  Payload ID: 4960
  Gene Symbol: DDIAS
  Gene Name: DNA damage-induced apoptosis suppressor
  Uniprot ID: Q8IXT1
  ENST ID: ENST00000533655
  CDS Start-End: 213-3209
gggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaa

SEQ ID NO: 127543 - DNA, 1830 bp, Homo sapiens
  Payload ID: 4960
  Gene Symbol: DDIAS
  Gene Name: DNA damage-induced apoptosis suppressor
  Uniprot ID: Q8IXT1
  ENST ID: ENST00000525361
  CDS Start-End: 456-992
aaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagatggagttttgctcttgttgcccaggctgaagtgccatggtgcaatctcggctcactgcaacctccgcatcctaggttcaagcaattctcctgccgcagcctcctgagtagctgggattacaggcaccccccaccatgctcagctactttttgtatttagtggagatggggtttcaccatgttggccaggctggtctcaaactccctacctcagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccaaagcactagtggcttgccagattgttctaccagacccagccacccaagatgctaaaacaaaataagaccaaggggaagaagatggctggggcccctgctgtcatgaagaagcaagaagccaagaaagtggtgaatctcccctgtttgagaaaaggcctaagaattttagcactggacaggacatccaccccaaagggatctcactcactttgtcaaatggcctcattatattaggttgcagcagcaaagaactatcctctgtaggtcactggaagtgcctcttgtgattaaccagtttacccaggccttggacctcctaacagctgctcagcttcttaagctggcccacgagtacagaccagtgacaaagcaagagaagaagcaggaattgttggcccatgctgacaggaatgctgccagcaatggagacatccccactaagagttcacctgtccttcaagcaggggttaatactgtcaccaactcaatggtgaacaagaagtctcagctggtgctgactgcacaagatatggatcccatcaagctggttgtcttcctgccagccctgtgttgtaaaatgggggtcccttactgtgttatcaaagagaaggcaaggccgggaagtttagtccacaggaggacctgcatcattgtcaccttcacacaggttaaatggaaaaaacaaggagctttagctaaactttgggagcttcaggatcaattacaatgacagatataatgagatccaccatcaatggggaggcaacatcctgggtccaaaatctgtggcttacaatgccaagccagaaaagacaaaggctaaaaaacatgccactaagcttagttaaatgcacactgttgagttttctgtacagaaagataataaaaaattctccttcagcc

SEQ ID NO: 127544 - DNA, 607 bp, Homo sapiens
  Payload ID: 4960
  Gene Symbol: DDIAS
  Gene Name: DNA damage-induced apoptosis suppressor
  ENST ID: ENST00000524921
  CDS Start-End: 242-604
aaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacagaattttgaaaaccaacctggacaaggttcagatgccagtaacttcttacagcaatgctctgaccacaaaagaaaagccaaagcactagtgg

SEQ ID NO: 127545 - DNA, 961 bp, Homo sapiens
  Payload ID: 4960
  Gene Symbol: DDIAS
  Gene Name: DNA damage-induced apoptosis suppressor
  ENST ID: ENST00000525388
  CDS Start-End: 202-564
aaggctgccggcgtgctactgagttcggccggtccgagtcactgtgcgtcgcctgggcccgttcctggtcttctcccccagatagggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacagaattttgaaaaccaacctggacaaggttcagatgccagtaacttcttacagcaatgctctgaccacaaaagaaaagccaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattca

SEQ ID NO: 127546 - DNA, 3105 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000338895
  CDS Start-End: 338-1426
acaaggggagggctccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtggcaaggactttggaggatgtgtcttctgctggaccggcaccttttgtttgtcccattggtggcagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttc

SEQ ID NO: 127547 - DNA, 3005 bp, Homo sapiens
  Payload ID: 4961
  Gene Symbol: DFFB
  Gene Name: DNA fragmentation factor, 40kDa, beta polypeptide (caspase-activated DNase)
  Uniprot ID: O76075
  ENST ID: ENST00000339350
  CDS Start-End: 132-482
ggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctctgttggtgtcagggcaaggacaaagacccgggacacctcaagtctgagtcctggtgattgccaggccctggggaatgggggaagatgtggtcagaggctcttcttgtgaccggggcaggatgtgtcttctgctggaccggcaccttttgtttgtcccattggtggcagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127548 - DNA, 572 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000341385
  CDS Start-End: 1-249
atgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtgatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtga

SEQ ID NO: 127549 - DNA, 2842 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000378206
  CDS Start-End: 88-330
ccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgatgtgtcttctgctggaccggcaccttttgtttgtcccattggtggcagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127550 - DNA, 3028 bp, Homo sapiens
  Payload ID: 4961
  Gene Symbol: DFFB
  Gene Name: DNA fragmentation factor, 40kDa, beta polypeptide (caspase-activated DNase)
  Uniprot ID: O76075
  ENST ID: ENST00000378209
  CDS Start-End: 324-1340
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127551 - DNA, 3152 bp, Homo sapiens
  Payload ID: 4961
  Gene Symbol: DFFB
  Gene Name: DNA fragmentation factor, 40kDa, beta polypeptide (caspase-activated DNase)
  Uniprot ID: O76075
  ENST ID: ENST00000491998
  CDS Start-End: 324-1136
ccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacatagatggagtcttgctctgtggcccaggctaaagtgcagtggcaggatcatggctcactgaagccctgaactcctggcctcaagcaatcctcctgcctcagcctcctgagtcgctgggactacagaatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127552 - DNA, 2923 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000477548
  CDS Start-End: 132-443
ggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctggtttcgccatgtttcccaggatagtctcacactcctgggctcaagctgtcctcctgccttggtctcctaaagtgctgggattacagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127553 - DNA, 686 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000461150
  CDS Start-End: 1-235
aatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127554 - DNA, 2986 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000468793
  CDS Start-End: 145-492
agtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtggcaaggactttggagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggctggagtgcagtggcgtgatcttggctcaccgcaacctctgcctccctgcaccctctgcctcccaggttaaagcgattctcctgcctcagcctcccgagtagctgggattacaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127555 - DNA, 2731 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000475969
  CDS Start-End: 5-352
tgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctgtgagtggcaaggactttggagatgtgagcgacatcaggcgcttcctcagtgcatttcacgagccacaggtggggctcatccaggccgcccagcagctgctgtgtgatgagcaggccccacagaggcagaggctgctggctgacctcctgcacaacgtcagccagaacatcgcggccgagacccgggctgaggacccgccgtggtttgaaggcttggagtcccgatttcagagcaagtctggctatctgagatacagctgtgagagccggatccggagttacctgagggaggtgagctcctacccctccacggtgggtgcggaggctcaggaggaattcctgcgggtcctcggctccatgtgccagaggctccggtccatgcagtacaatggcagctacttcgacagaggagccaagggcggcagccgcctctgcacaccggaaggctggttctcctgccagggtccctttgacatggacagctgcttatcaagacactccatcaacccctacagtaacagggagagcaggatcctcttcagcacctggaacctggatcacataatagaaaagaaacgcaccatcattcctacactggtggaagcaattaaggaacaagatggaagagaagtggactgggagtatttttatggcctgctttttacctcagagaacctaaaactagtgcacattgtctgccataagaaaaccacccacaagctcaactgtgacccaagcagaatctacaaaccccagacaaggttgaagcggaagcagcctgtgcggaaacgccagtgacacgtacacaccacgtcctggtctttgtttgaggcctgacgtgggcatcattttaacaggtgccttttttgtttttttgtttttcgtttttttggtcactccagtagctcctggaaaaaaccttaaaaaatgtttcctccaaatctgatttcattacatttctgaattgttggggttttttttgttgttttgttttgttttgtagatggagtttcacttttgttgcccaggctggagtgtagtggcgcgatctcggctcagcctcccgagtagctgggattacaggcatgtgccaccacgcccggctaatgtttgtatttttagtagagacggggtttcaccatgttggtcaggctggtctcaaactcctgacctcaggtgatccgcccacctcagcctcccaaagtgctgggatgacaggtgtgagccactgcgcccagcctgaatcatttcttataccttctgacagcccaacttccagaggacagctctggggtactcgttggatgtctgtgagtacctggtcatacgggtcagtagggataagaattgtctctgggctgaggaattcttctgttctctggtttcaccagcgttgggtttgctcatgtaatgtggtcaccatactcaaatggtgtcatggctgaagttggccaccttgcttgagggacaagttgtttatgtatcagctctctgctgggtctccctttccatggcaaatgggcagctccatcctcttgactcttctaaatgcccaaaagaggtgtcatgctttgggggtacgatgtttatactccgtaaagaacatacaaggacattcactgctgatttttttttttgtttgtttgagacagggtctcactctgtcgctcaggctggagtgcagtgatgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaataga

SEQ ID NO: 127556 - DNA, 649 bp, Homo sapiens
  Payload ID: 4961
  Gene Symbol: DFFB
  Gene Name: DNA fragmentation factor, 40kDa, beta polypeptide (caspase-activated DNase)
  ENST ID: ENST00000625756
  CDS Start-End: 338-649
acaaggggagggctccgctactctggccctcagggttgtgtagtttccggggccacggcacctgggcacaccaggtggcgtcgcgcctttgctttcctgagccttctgagtaaggtaatgtggtgtccgtggggcgacgcctgcgcacaagaccgcgtcgggcctcacttttcccaggccttctgggtaatgtagtttccgggatcggcacccggcctgtgccagcttgcagagctcaccaggtgcagacccctgcggccagggcgaggacggatctgagcagctgggcagcaggtgccaccgcctgtgggacccagagggcttgaggacatctgcaatgctccagaagcccaagagcgtgaagctgcgggccctgcgcagcccgaggaagttcggcgtggctggccggagctgccaggaggtgctgcgcaagggctgtctccgcttccagctccctgagcgcggttcccggctgtgcctgtacgaggatggcacggagctgacggaagattacttccccagtgttcccgacaacgccgagctggtgctgctcaccttgggccaggcctggcagggctggtttcgccatgtttcccaggatagtctcacactcctgggctcaagctgtcctcctgccttggtctcctaa

SEQ ID NO: 127557 - DNA, 1403 bp, Homo sapiens
  Payload ID: 4962
  Gene Symbol: DFFA
  Gene Name: DNA fragmentation factor, 45kDa, alpha polypeptide
  Uniprot ID: O00273
  ENST ID: ENST00000377036
  CDS Start-End: 31-837
cgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggactt

SEQ ID NO: 127558 - DNA, 6032 bp, Homo sapiens
  Payload ID: 4962
  Gene Symbol: DFFA
  Gene Name: DNA fragmentation factor, 45kDa, alpha polypeptide
  Uniprot ID: O00273
  ENST ID: ENST00000377038
  CDS Start-End: 69-1064
gagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctcaaaaaaaaaaaaaaaaaggacaggcacgacagtggctcacacctttgatcccagcactttggaggccgatgcaggcggatcacatgaggtcaggagttcaagaccaacctggccaatatggtgaaaccccgtctctactaaaaatacaaaaattagctgggcatgatggcgggtgcctgtaatcccagctactcggtaggcagaggttgcagtgagctgagagcgcaccactgcactccagcctgggtgacagagctagactccgtatctcaagaaaaaaaaaaagttttgttttgtttttttgagacagagtctcactctgtcacctagtctggagtgcagtggcacattctcggctcactgcaacccccacctcccaggttcaagcgattctcctgtttcagcctcctgagcagctgggattacaggcacgtgccaccatgcccggctaatttttgtatttttagtagagacagggttttgtcacattggccaggctggtctcaaactcctgacctcaggtgatccacccacctcagcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactgaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaaaaaaaagaaaatcacaataagtcctagggtaaagatgggggtacagaaaacaattaaatagaacaaaaacaactgtttccttttcctgtgattcaagaagggcttagatcttctactcagcatccttttactaatgccctccattggctctcaccccaacatttccttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgacagaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacaatgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcctaa

SEQ ID NO: 127559 - DNA, 744 bp, Homo sapiens
  Payload ID: 4962
  Gene Symbol: DFFA
  Gene Name: DNA fragmentation factor, 45kDa, alpha polypeptide
  ENST ID: ENST00000476658
  CDS Start-End: 22-501
gcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagagttggttaccaaggaagaccccaaagcactggctgttgccttgaactgggacataaagaag

SEQ ID NO: 127560 - DNA, 2371 bp, Homo sapiens
  Payload ID: 4963
  Gene Symbol: DMC1
  Gene Name: DNA meiotic recombinase 1
  Uniprot ID: Q14565
  ENST ID: ENST00000216024
  CDS Start-End: 278-1300
gcccctcgtcgccctctgtaggcctgctccctccccgcccttccaccctcaccctgcgccccgccccggccccttggtcctcgccccgccctcctcgtttggcgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtgtgacagctcaacttccaggagctggtggctacccaggaggaaagattatcttcattgatacagaaaatactttccgtccagatcgccttagggacattgctgatcgctttaatgtagaccatgatgcagtactggacaacgtactttatgcacgtgcatatactagtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgc

SEQ ID NO: 127561 - DNA, 721 bp, Homo sapiens
  Payload ID: 4963
  Gene Symbol: DMC1
  Gene Name: DNA meiotic recombinase 1
  ENST ID: ENST00000439567
  CDS Start-End: 112-721
ccgagttagaatcctgtcagctgaggaggtcgggcggggcagaggggcttcaccttgaaaatctcggggagactgtggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtggtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaag

SEQ ID NO: 127562 - DNA, 569 bp, Homo sapiens
  Payload ID: 4963
  Gene Symbol: DMC1
  Gene Name: DNA meiotic recombinase 1
  ENST ID: ENST00000415483
  CDS Start-End: 154-569
ctcatctttccaagctaaatgcttctcttactgtccttctagtccttgttgactttgaaatgaaatcagaggcccctggacaaaggactacttcttacataatatttcttattttcccagaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccct

SEQ ID NO: 127563 - DNA, 2082 bp, Homo sapiens
  Payload ID: 4963
  Gene Symbol: DMC1
  Gene Name: DNA meiotic recombinase 1
  Uniprot ID: Q14565
  ENST ID: ENST00000428462
  CDS Start-End: 154-1011
ctcatctttccaagctaaatgcttctcttactgtccttctagtccttgttgactttgaaatgaaatcagaggcccctggacaaaggactacttcttacataatatttcttattttcccagaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtggtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgc

SEQ ID NO: 127564 - DNA, 1595 bp, Homo sapiens
  Payload ID: 4963
  Gene Symbol: DMC1
  Gene Name: DNA meiotic recombinase 1
  ENST ID: ENST00000616615
  CDS Start-End: 176-673
cgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtgtgacagctcaacttccaggagctggtggctacccaggaggaaagattatcttcattgatacagaaaatactttgtaacctttttatttaaagttgctaacataatagtgtgatataggaatgttaccactgaagagtttgtctgagatatacaatctttgtagtcattccataaaccagtagtaatgagacaaaccaaagggaaaacaattactgtttaagttctccaatcactttgtatttaatgaggtttcacttcttcatatgggtttatgagacaaaacaaatacatgagaggaaattatatcatcatttttaatcctcttacttctctaaagatgttgcttaatagttagaaaaaagatttttttttttttgagacggaatctccctgttgcccaggctggagtccagtggggcaatctcggctcactgcaacctccatctcttgggttcaatcaattctcctgcctcagcctaccgagtagctgggattacaggtgtgtgccaccacacctggctaatttttttgtatttttagtagagacagggttttgacatgttgaccaggctgttctggaactcctgacctcaggtgatccacctgcctcagcctcccacagtgctaggattacaggcgtgagccacgatgcccggcctgcaatttggattttactaagaacaataggaatacttaggagctaagtcatatgcaagagagagtggagaagaacagctgggtgggggtgcagggcactgtggcaagggccacattggagtgttctcattctttccgtgtctcatacttatactgctgtctcttgatagttttctttttatatgtttatattttgcctccttaattatgttttaaatttacctagggcataggttgtcttaggactccttatatcctccataatgctttgccttggtaattgattaatatggtaattaattccatatggtaattggttaataaatatttataattgatctg

SEQ ID NO: 127565 - DNA, 1552 bp, Homo sapiens
  Payload ID: 4964
  Gene Symbol: DMAP1
  Gene Name: DNA methyltransferase 1 associated protein 1
  Uniprot ID: Q9NPF5
  ENST ID: ENST00000315913
  CDS Start-End: 86-1489
acgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccaggctg

SEQ ID NO: 127566 - DNA, 1545 bp, Homo sapiens
  Payload ID: 4964
  Gene Symbol: DMAP1
  Gene Name: DNA methyltransferase 1 associated protein 1
  Uniprot ID: Q9NPF5
  ENST ID: ENST00000361745
  CDS Start-End: 79-1482
accgccggaagtttctgccgcggctttgcggggacgggggagtggtagtgggggctgcagctgccggacccaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccaggctg

SEQ ID NO: 127567 - DNA, 1730 bp, Homo sapiens
  Payload ID: 4964
  Gene Symbol: DMAP1
  Gene Name: DNA methyltransferase 1 associated protein 1
  Uniprot ID: Q9NPF5
  ENST ID: ENST00000372289
  CDS Start-End: 264-1667
ggggagtggtagtgggggctgcagctgccggacccaggtgcggaagtgcgagggcccaggtggctgaaggggccgttaggaacatccaagcggtggggcacaggcagatccccgacctgacctggaccacccttctcctcttggcccgccccttcaactcgcctccgcttaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccaggctg

SEQ ID NO: 127568 - DNA, 396 bp, Homo sapiens
  Payload ID: 4964
  Gene Symbol: DMAP1
  Gene Name: DNA methyltransferase 1 associated protein 1
  ENST ID: ENST00000372290
  CDS Start-End: 1-396
attatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataaggagtaccagctttatctccacgatgatgcttggactaaggcagaaactgaccacctctttgacctcagccgccgctttgacctgcgtttt

SEQ ID NO: 127569 - DNA, 599 bp, Homo sapiens
  Payload ID: 4964
  Gene Symbol: DMAP1
  Gene Name: DNA methyltransferase 1 associated protein 1
  ENST ID: ENST00000436069
  CDS Start-End: 147-599
cgcggctttgcggggacgggggagtggtagtgggggctgcagctgccggacccaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaacaagggctcctgcttgcttagcaggatgcaggaggacctgaagtcttttgctccaggacatgactttcttgctataggggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccc
